US007622260B2

(12) United States Patent
Gordon et al.

(10) Patent No.: US 7,622,260 B2
(45) Date of Patent: Nov. 24, 2009

(54) DIAGNOSTIC AND PROGNOSTIC TESTS

(75) Inventors: Gavin J. Gordon, West Newbury, MA (US); Roderick V. Jensen, Pelham, CT (US); Steven R. Gullans, Natick, MA (US); Raphael Bueno, Brookline, MA (US); Li-Li Hsiao, Jamaica Plain, MA (US)

(73) Assignees: The Brigham and Women's Hospital, Inc., Boston, MA (US); Wesleyan University, Middletown, CT (US)

( * ) Notice: Subject to any disclaimer, the term of this patent is extended or adjusted under 35 U.S.C. 154(b) by 577 days.

(21) Appl. No.: 10/236,031

(22) Filed: Sep. 5, 2002

(65) Prior Publication Data

US 2003/0219760 A1 Nov. 27, 2003

Related U.S. Application Data

(60) Provisional application No. 60/317,389, filed on Sep. 5, 2001, provisional application No. 60/407,431, filed on Aug. 30, 2002.

(51) Int. Cl.
C12Q 1/68 (2006.01)
G01N 33/53 (2006.01)

(52) U.S. Cl. ............................................. 435/7.1; 435/6
(58) Field of Classification Search ...................... 435/6, 435/7.1
See application file for complete search history.

(56) References Cited

U.S. PATENT DOCUMENTS

| 5,770,176 | A | 6/1998 | Nargessi |
| 5,840,484 | A | 11/1998 | Seilhamer et al. |
| 6,040,138 | A | 3/2000 | Lockhart et al. |
| 2009/0104617 | A1 | 4/2009 | Gordon et al. |

FOREIGN PATENT DOCUMENTS

| WO | WO 00/55633 A2 | 9/2000 |
| WO | WO 03/021229 A2 | 3/2003 |

OTHER PUBLICATIONS

Reimer et al (Cancer Research, Feb. 15, 2000, 60:822-826).*
Beer et al., Gene-expression profiles predict survival of patients with lung adenocarcinoma. Nat Med. Aug. 2002; 8(8):816-24.
Bhattacharjee et al., Classification of human lung carcinomas by mRNA expression profiling reveals distinct adenocarcinoma subclasses. Proc Natl Acad Sci U S A. Nov. 20, 2001;98(24):13790-5.
Clark et al., Genomic analysis of metastasis reveal an essential role for RhoC. Nature. Aug. 3, 2000;406(6795):532-5.
Dhanasekaran et al., Delineation of prognostic biomarkers in prostate cancer. Nature. Aug. 23, 2001;412(6849):822-6.
Dudoit et al., Comparison of discrimination methods for the classification of tumors using gene expression data. J Am Stat Assoc. 2002; 97(457):77-87.
Fodor et al., Massively parallel genomics. Science. 1997; 277:393-5.
Golub et al., Molecular classification of cancer: class discovery and class prediction by gene expression monitoring. Science. Oct. 15, 1999;286(5439):531-7.
Gordon et al., Translation of microarray data into clinically relevant cancer diagnostic test using gene expression ratios in lung cancer and mesothelioma. Cancer Res. Sep. 1, 2002;62(17):4963-7.
Gordon et al., Validation of genomics-based prognostic tests in malignant pleural mesothelioma. Clin Cancer Res. Jun. 15, 2005;11(12):4406-14.
Gordon et al., Using gene expression ratios to predict outcome among patients with mesothelioma. J Natl Cancer Inst. Apr. 16, 2003;95(8):598-605.
Gullans et al., Of microarrays and meandering data points. Nat Genet. Sep. 2000;26(1):4-5.
Gwynne et al., Microarray Analysis: the next revolution in Molecular Biology. Science eMarketplace. Science. Aug. 6, 1999. (science.org/feature/e-market/benchtop/micro.shl).
Hedenfalk et al., Gene-expression profiles in hereditary breast cancer. N Engl J Med. Feb. 22, 2001;344(8):539-48.
Hough et al., Large-scale serial analysis of gene expression reveals genes differentially expressed in ovarian cancer. Cancer Res. Nov. 15, 2000;60(22):6281-7.
Hsiao et al., A compendium of gene expression in normal human tissues. Physiol Genomics. Dec. 21, 2001;7(2):97-104.
Khan et al., Classification and diagnostic prediction of cancers using gene expression profiling and artificial neural networks. Nat Med. Jun. 2001;7(6):673-9.
O'Dell et al., Associations of IGF2 ApaI RFLP and INS VNTR class I allele size with obesity. Eur J Hum Genet. Oct.-Nov. 1999;7(7):821-7.
Perou et al., Molecular portraits of human breast tumours. Nature. Aug. 17, 2000;406(6797):747-52.
Pomeroy et al., Prediction of central nervous system embryonal tumour outcome based on gene expression. Nature. Jan. 24, 2002;415(6870):436-42.
Quackenbush et al., Computational analysis of microarray data. Nat Rev Genet. Jun. 2001;2(6):418-27.
Rosenwald et al., The use of molecular profiling to predict survival after chemotherapy for diffuse large-B-cell lymphoma. N Engl J Med. Jun. 20, 2002;346(25):1937-47.
Shipp et al., Diffuse large B-cell lymphoma outcome prediction by gene-expression profiling and supervised machine learning. Nat Med. Jan. 2002;8(1):68-74.

*Primary Examiner*—Sean E Aeder
(74) *Attorney, Agent, or Firm*—Wolf, Greenfield & Sacks, P.C.

(57) ABSTRACT

The invention provides methods for diagnosing biological states or conditions based on ratios of gene expression data from tissue samples, such as cancer tissue samples. The invention also provides sets of genes that are expressed differentially in malignant pleural mesothelioma. These sets of genes can be used to discriminate between normal and malignant tissues, and between classes of malignant tissues. Accordingly, diagnostic assays for classification of tumors, prediction of tumor outcome, selecting and monitoring treatment regimens and monitoring tumor progression/regression also are provided.

17 Claims, 7 Drawing Sheets

OTHER PUBLICATIONS

Sugarbaker et al., Extrapleural pneumonectomy in the multimodality therapy of malignant pleural mesothelioma. Results in 120 consecutive patients. Ann Surg. Sep. 1996;224(3):288-94; discussion 294-6.

Sugarbaker et al., Node status has prognostic significance in the multimodality therapy of diffuse, malignant mesothelioma. J Clin Oncol. Jun. 1993;11(6):1172-8.

Sugarbaker et al., Resection margins, extrapleural nodal status, and cell type determine postoperative long-term survival in trimodality therapy of malignant pleural mesothelioma: results in 183 patients. J Thorac Cardiovasc Surg. Jan. 1999;117(1):54-63; discussion 63-5.

Tusher et al., Significance analysis of microarrays applied to the ionizing radiation response. Proc Natl Acad Sci U S A. Apr. 24, 2001;98(9):5116-21.

Van 'T Veer et al., Gene expression profiling predicts clinical outcome of breast cancer. Nature. Jan. 31, 2002;415(6871):530-6.

Virtaneva et al., Expression profiling reveals fundamental biological differences in acute myeloid leukemia with isolated trisomy 8 and normal cytogenetics. Proc Natl Acad Sci U S A. Jan. 30, 2001;98(3):1124-9.

Wang et al., Monitoring gene expression profile changes in ovarian carcinomas using cDNA microarray. Gene. Mar. 18, 1999;229(1-2):101-8.

Warrington et al., Comparison of human adult and fetal expression and identification of 535 housekeeping/maintenance genes. Physiol Genomics. Apr. 27, 2000;2(3):143-7.

Welsh et al., Analysis of gene expression profiles in normal and neoplastic ovarian tissue samples identifies candidate molecular markers of epithelial ovarian cancer. Proc Natl Acad Sci U S A. Jan. 30, 2001;98(3):1176-81.

Welsh et al., Analysis of gene expression identifies candidate markers and pharmacological targets in prostate cancer. Cancer Res. Aug. 15, 2001;61(16):5974-8.

Calvo, R. et al., Altered HOX and WNT7A expression in human lung cancer. Proc Natl Acad Sci U S A. Nov. 7, 2000;97(23):12776-81.

Frank, S. et al., Identification of a differential expression of two cDNAs between malignant mesothelioma and normal mesothelial cells using the RNA fingerprint method. Tumour Biol. 1998;19(3):153-9.

Frank, S. et al., Identification of genes involved in human mesothelial cancer progression using a modified differential display technique. Cancer Lett. Jan. 16, 1998;123(1):7-14.

Kettunen, E. et al., Gene expression profiling of malignant mesothelioma cell lines: cDNA array study. Int J Cancer. Feb. 15, 2001;91(4):492-6.

Liu, Z et al. Expression and activity of matrix metalloproteases in human malignant mesothelioma cell lines. Int J Cancer. Mar. 1, 2001;91(5):638-43.

Mohr, S et al. [Gene expression profiling in human mesothelioma cells using DNA microarray and high-density filter array technologies] Bull Cancer. Mar. 2001;88(3):305-13. French.

Rihn, BH et al. Differential gene expression in mesothelioma. FEBS Lett. Sep. 1, 2000;480(2-3):95-100.

Sandhu, H. et al., mRNA expression patterns in different stages of asbestos-induced carcinogenesis in rats. Carcinogenesis. May 2000;21(5):1023-9.

Sun, X. et al., Upregulation of 9 genes, including that for thioredoxin, during epithelial differentiation of mesothelioma cells. Differentiation. Dec. 2000;66(4-5):181-8.

Goetz, M.P. et al., A two-gene expression ratio of homeobox 13 and interleukin-17B receptor for prediction of recurrence and survival in women receiving adjuvant tamoxifen. Clin Cancer Res. Apr. 1, 2006;12(7 Pt. 1):2080-7.

Granville, C.A. and Dennis, P.A. An overview of lung cancer genomics and proteomics. Am J Respir Cell Mol Biol. Mar. 2005;32(3):169-76.

Groskopf, J. et al., APTIMA PCA3 molecular urine test: development of a method to aid in the diagnosis of prostate cancer. Clin Chem. Jun. 2006;52(6):1089-95. Epub Apr. 20, 2006.

Groskopf, J. et al., PCA3 Molecular Urine Assay: Characterization of a Method to Aid in the Diagnosis of Prostate Cancer, Poster 2006 European Association of Urology, Paris France.

Hofmann, H. S. et al., Discrimination of human lung neoplasm from normal lung by two target genes. Am J Respir Crit Care Med. Sep. 1, 2004;170(5):516-9.

Jansen, M.P. et al., Re: Limits of predictive models using microarray data for breast cancer clinical treatment outcome. J Natl Cancer Inst. Dec. 21, 2005;97(24):1851-2; author reply 1852-3.

Ma, X.J. et al., A two-gene expression ratio predicts clinical outcome in breast cancer patients treated with tamoxifen. Cancer Cell. Jun. 2004;5(6):607-16.

Reid, J.F. et al., Limits of predictive models using microarray data for breast cancer clinical treatment outcome, J Natl Cancer Inst. Jun. 15, 2005;97(12):927-30.

Vachani, A. et al., A 10-gene classifier for distinguishing head and neck squamous cell carcinoma and lung squamous cell carcinoma. Clin Cancer Res. May 15, 2007;3(10):2905-15.

Chhieng, D.C. et al., Calretinin staining pattern aids in the differentiation of mesothelioma from adenocarcinoma in serious effusions. Cancer. Jun. 25, 2000;90(3):194-200.

Paramothayan, N.S and Barron, J. New criteria for the differentiation between transudates and exudates. J Clin Pathol. Jan. 2002;55(1):69-71.

Crnogorac-Jurcevic, T. et al., Gene expression profiles of pancreatic cancer and stromal desmoplasia. Oncogene. Nov. 1, 2001;20(50):7437-46.

Garber, M.E. et al., Diversity of gene expression in adenocarcinoma of the lung. Proc Natl Acad Sci U S A. Nov. 20, 2001;98(24):13784-9. Epub Nov. 13, 2001. Erratum in: Proc Natl Acad Sci U S A Jan. 22, 2002;99(2):1098.

Su, A.I. et al., Molecular classification of human carcinomas by use of gene expression signatures. Cancer Res. Oct. 15, 2001;61(20):7388-93.

Alizadeh et al., Distinct types of diffuse large B-cell lymphoma identified by gene expression profiling. Nature. Feb. 3, 2000;403(6769):503-511.

Ara et al., Determination of imbalance between MMP-2 and TIMP-2 in human neuroblastoma by reverse-transcription polymerase chain reaction and its correlation with tumor progression. J Pediatr Surg. Mar. 2000;35(3):432-437.

Assersohn et al., The feasibility of using fine needle aspiration from primary breast cancers for cDNA microarray analyses. Clin Cancer Res. Mar. 2002;8(3):794-801.

Borczuk et al., Molecular signatures in biopsy specimens of lung cancer. Am J Respir Crit Care Med. Jul. 15, 2004;170(2):167-174. Epub Apr. 15, 2004.

Bueno et al., A diagnostic test for prostate cancer from gene expression profiling data. J Urol. Feb. 2004;171(2 Pt 1):903-906.

Di Loreto et al., TTF-1 protein expression in pleural malignant mesotheliomas and adenocarcinomas of the lung. Cancer Lett. Feb. 13, 1998;124(1):73-78.

Gohji et al., Serum matrix metalloproteinase-2 and its density in men with prostate cancer as a new of disease extension. Int J Cancer. Feb. 20, 1998;79(1):96-101.

Gordon et al., A prognostic test for adenocarcinoma of the lung from gene expression profiling data. Cancer Epidemiol Biomarkers Prev. Sep. 2003;12(9):905-910.

Gordon et al., Differential diagnosis of solitary lung nodules with gene expression ratios. J Thorac Cardiovasc Surg. Sep. 2006;132(3):621-627.

Lapointe et al., Gene expression profiling identifies clinically relevant subtypes of prostate cancer. Proc Natl Acad Sci U S A. Jan. 20, 2004;101(3):811-816. Epub Jan. 7, 2004.

Lee et al., Microarray profiling of isolated abdominal subcutaneous adipocytes from obese vs nonobese Pima Indians: increased expression of inflammation-related genes. Diabetologia. Sep. 2005;48(9):1776-1783. Epub Jul. 30, 2005.

Lozano et al., Immunocytochemistry in the differential diagnosis of serous effusions: a comparative evaluation of eight monoclonal antibodies in Papanicolaou stained smears. Cancer. Feb. 25, 2001;93(1):68-72.

Ordóñez, the immunohistochemical diagnosis of epithelial mesothelioma. Hum Pathol. Mar. 1999;30(3):313-323.

Ordóñez, The value of antibodies 44-3A6, SM3, HBME-1, and thrombomodulin in differentiating epithelial pleural mesothelioma from lung adenocarcinoma: a comparative study with other commonly used antibodies. Am J Surg Pathol. Dec. 1997;21(12):1399-1408.

Sato et al., Differential diagnosis of mesothelial and ovarian cancer cells in ascites by immunocytochemistry using Ber-EP4 and calretinin. Acta Cytol. May-Jun. 2000;44(3):485-488.

Sotiriou et al., Gene expression profiles derived from fine needle aspiration correlate with response to systemic chemotherapy in breast cancer. Breast Cancer Res. 2002;4(3):R3. Epub Mar. 20, 2002.

Still et al., Localization and quantification of mRNA for matrix metalloproteinase-2 (MMP-2) and tissue inhibitor of matrix metalloproteinase-2 (TIMP-2) in human benign and malignant prostatic tissue. Prostate. Jan. 2000;42(1):18-25.

Zumoff et al., Sex differences in the twenty-four-hour mean plasma concentrations of dehydroisoandrosterone (DHA) and dehydroisoandrosterone sulfate (DHAS) and the DHA to DHAS ratio in normal adults. J Clin Endocrinol Metab. Aug. 1980;51(2):330-333.

\* cited by examiner

DIAGNOSTIC AND PROGNOSTIC TESTS

RELATED APPLICATIONS

This application claims the benefit under 35 U.S.C. § 119 (e) of U.S. provisional application No. 60/317,389, filed Sep. 5, 2001, and U.S. provisional application 60/407,431, filed Aug. 30, 2002, the entire disclosures of which are incorporated herein by reference.

GOVERNMENT SUPPORT

The invention was made with government support under grant No. DK58849 awarded by the National Institutes of Health. The United States Government has certain rights in the invention.

FIELD OF THE INVENTION

The invention relates to methods for diagnosing conditions, predicting prognoses and optimizing treatment strategies using ratios of gene expression data. The invention also relates to nucleic acid markers for cancer, particularly for distinguishing malignant pleural mesothelioma from other lung cancers or from normal lung tissue, and for distinguishing between subclasses of malignant pleural mesothelioma.

BACKGROUND OF THE INVENTION

Although much progress has been made toward understanding the biological basis of cancer and in its diagnosis and treatment, it is still one of the leading causes of death in the United States. Inherent difficulties in the diagnosis and treatment of cancer include among other things, the existence of many different subgroups of cancer and the concomitant variation in appropriate treatment strategies to maximize the likelihood of positive patient outcome.

Subclassification of cancer has typically relied on the grouping of tumors based on tissue of origin, histology, cytogenetics, immunohistochemistry, and known biological behavior. The pathologic diagnosis used to classify the tumor taken together with the stage of the cancer is then used to predict prognosis and direct therapy. However, current methods of cancer classification and staging are not completely reliable.

Gene expression profiling using microarrays is likely to result in improvements in cancer classification and prediction of prognosis (Golub, 1999; Perou, 2000; Hedenfalk, 2001; Khan, 2001). Still, the wealth of information garnered using microarrays has, thus far, not yielded effective clinical applications. Global expression analysis has led to the development of sophisticated computer algorithms seeking to extend data analysis beyond simple expression profiles (Quackenbush, 2001; Khan, 2001). At this time, however, no clear consensus exists regarding which computational tools are optimal for the analysis of large gene expression profiling data sets, particularly in the clinical setting. Moreover, many of these bioinformatics tools under development and testing are quite complex leaving the practical use of microarray data beyond the scope of many biomedical scientists and/or clinicians. With rare exceptions (e.g. PSA and prostate cancer), it is generally assumed that expression levels of any one gene are insufficient in the diagnosis and/or prognosis of cancer. However, it is equally erroneous to assume a priori that the expression profiles of large numbers of genes are explicitly required for this purpose.

It is difficult to predict from standard clinical and pathologic features the clinical course of cancer. However, it is very important in the treatment of cancer to select and implement an appropriate combination of therapeutic approaches. The available methods for designing strategies for treating cancer patients are complex and time consuming. The wide range of cancer subgroups and variations in disease progression limit the predictive ability of the healthcare professional. In addition, continuing development of novel treatment strategies and therapeutics will result in the addition of more variables to the already complex decision-making process involving matching the cancer patient with a treatment regimen that is appropriate and optimized for the cancer stage, tumor growth rate, and other factors central to the individual patient's prognosis. Because of the critical importance of selecting appropriate treatment regimens for cancer patients, the development of guidelines for treatment selection is of key interest to those in the medical community and their patients. Thus, there presently is a need for objective, reproducible, and sensitive methods for diagnosing cancer, predicting cancer patient prognosis and outcome, and selecting and monitoring optimal treatment regimens.

SUMMARY OF THE INVENTION

Using focused microarray-based expression profiling, a simple method was developed to diagnose and predict outcome in patients with malignant pleural mesothelioma (MPM). MPM is a mesodermally derived, neoplastic disease that arises in the pleura and relentlessly grows into adjacent structures until it ultimately results in the death of the patient. There are three distinct histological subtypes of MPM: epithelial, mixed, and sarcomatoid (Corson, 1996). Tumor specimens that are linked to a comprehensive clinical database were utilized to be able to directly correlate gene expression data to clinical variables such as survival and develop and test novel prognostic and diagnostic tests for MPM and other cancers. Additional tests have proven the applicability to cancers other than MPM, including lung adenocarcinoma, squamous carcinoma, medulloblastoma, prostate cancer, breast cancer, ovarian cancer, leukemias and lymphomas.

The diagnostic and prognostic methods that were developed utilize gene expression data from as few as two genes through the use of expression level ratios and rationally chosen thresholds. The effectiveness of unit-less ratios in diagnosing cancer types was demonstrated and confirmed using real time quantitative reverse-transcriptase polymerase chain reaction (RT-PCR). This is a simple, but powerful, use of microarray data that can be easily adapted to a clinical setting to diagnose cancer (and non-cancer tissue or diseases) and predict patient outcome without complex computer software or hardware. Accordingly, diagnostic assays for classification of tumors, prediction of tumor outcome, selecting and monitoring treatment regimens, and monitoring tumor progression/regression can now be based on the ratios of expression of a small number of genes.

The gene expression ratio concept can be applied to other tissues to diagnose or distinguish between tissues in different biological states, such as tissues from subjects having disease and not having disease, subjects that vary in response to pharmaceutical or that metabolize pharmaceutical at different rates, subjects that vary is disease susceptibility or predisposition, and the like. Thus a subject's prognosis or response to treatments, inter alia, can be determined through analysis of a limited set of genes in particular biological samples. Moreover, the gene expression data can be obtained from, and comparisons can be made between, a number of different methods including nucleic acid hybridization (e.g., microarrays) and nucleic acid amplification methods (e.g., RT-PCR).

According to one aspect of the invention, methods for diagnosing the presence in a biological sample of tissue in a first biological state, preferably cancer cells, in a tissue sample is provided. The methods include providing a set of two or more genes, wherein the set comprises at least one upregulated gene that is expressed in greater amounts in a tissue in a first biological state (preferably cancer cells) than in a second biological state (preferably corresponding non-cancer cells) and at least one downregulated gene that is expressed in lesser amounts in a tissue in the first biological state (preferably cancer cells) than in the second biological state (preferably corresponding non-cancer cells) The methods also include determining the expression levels of the set of two or more genes, and calculating a ratio of the expression level of the upregulated gene to the expression level of the downregulated gene, wherein the ratio is indicative of the presence of tissue in the first biological state (preferably cancer cells) in the tissue sample. Another preferred diagnostic use for the method is to identify non-cancer tissues or diseases.

In certain preferred embodiments, there is at least a 2-fold difference in mean expression levels between the at least one upregulated gene and the at least one downregulated gene. In other preferred embodiments, two or more expression ratios are calculated. In certain embodiments, the two or more expression ratios are combined, preferably by calculating the geometric mean of the two or more expression ratios.

In certain embodiments, the ratio is calculated by division of the expression level of one upregulated gene by the expression level of one downregulated gene, or by division of the expression levels of two or more upregulated genes by the expression level of one downregulated gene, or by division of the expression level of one upregulated gene by the expression levels of two or more downregulated genes, or by division of the expression levels of two or more upregulated genes by the expression levels of two or more downregulated genes.

In other embodiments, the methods also include transforming the expression level data for the upregulated and/or downregulated genes prior to calculating the ratio.

In still other embodiments, the expression levels are determined by a method selected from the group consisting of nucleic acid hybridization and nucleic acid amplification. In preferred embodiments, the nucleic acid hybridization is performed using a solid-phase nucleic acid molecule array. In other preferred embodiments, the nucleic acid amplification method is real-time PCR.

In yet other embodiments, the expression levels are determined by an immunological method, preferably using a solid-phase antibody array, an ELISA or ELISPOT assay.

According to preferred embodiments of the foregoing methods, the cancer is selected from the group consisting of malignant pleural mesothelioma, lung adenocarcinoma, squamous carcinoma, medulloblastoma, prostate cancer, breast cancer, diffuse large B-cell lymphoma, follicular lymphoma and ovarian cancer.

In certain embodiments, the least one ratio is indicative of the presence of cancer cells in the tissue sample. In other embodiments, the at least one ratio is indicative of the presence of non-cancer cells in the tissue sample.

Similar methods as those described above, for determining prognosis of a cancer patient, are also provided according to the invention.

According to another aspect of the invention, kits for cancer diagnosis are provided. The kits include a set of one or more ratios applicable to the analysis of gene expression data, wherein the ratio is calculated from the expression levels of at least one upregulated gene that is expressed in greater amounts in the cancer cells than in corresponding non-cancer cells and at least one downregulated gene that is expressed in lesser amounts in cancer cells than in corresponding non-cancer cells. In certain embodiments, the kit also includes instructions for the use of the one or more ratios in the diagnosis of the presence of cancer cells in a biological sample.

According to a further aspect of the invention, diagnostic systems are provided. The diagnostic systems include a measurement device that measures gene expression level data of a set of two or more genes, wherein the set comprises at least one upregulated gene that is expressed in greater amounts in a tissue in a first biological state (preferably cancer cells) than in a second biological state (preferably corresponding non-cancer cells) and at least one downregulated gene that is expressed in lesser amounts in the tissue in the first biological state (preferably cancer cells) than in the second biological state (preferably corresponding non-cancer cells). The system also includes a data transformation device that acquires the gene expression data from the measurement device and performs data transformation to calculate a ratio of the gene expression levels of the upregulated and downregulated genes.

In certain embodiments, the data transformation device selects gene expression data of a selected set of genes from the measurement device for calculating the ratio of the selected set of genes, wherein the ratio calculated from the gene expression data of the selected set of genes is diagnostic for a selected biological state, such as a condition, preferably cancer.

In other embodiments, the cancer diagnostic system also includes a user interface output device to output the ratio to a user. In preferred embodiments, the cancer diagnostic system also includes a database of ratios of gene expression that are diagnostic for cancers, and a comparison device that compares the ratio calculated from the measured gene expression to the diagnostic ratios stored in the database and outputs the comparison to the user interface output device. In other preferred embodiments, the cancer diagnostic system also includes a database of treatment information for specific cancers, wherein the comparison device identifies treatment information in the database for the specific cancer for which the diagnostic ratio matches the calculated ratio, and wherein the comparison outputs the treatment information to the user interface output device.

According to yet another aspect of the invention, methods for diagnosing malignant pleural mesothelioma in a subject suspected of having malignant pleural mesothelioma are provided. The methods include obtaining from the subject a tissue sample suspected of being cancerous, determining the expression of a set of nucleic acid molecules or expression products thereof in the tissue sample, wherein the set of nucleic acid molecules includes at least two nucleic acid molecules selected from the group consisting of SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. Preferably the set of nucleic acids includes at least 3, 4, 5, 6, 7, 8, 9, 10, 11, 12, 13, 14, 15, 16, 17, 18, 19, 20, 21, 22, 23, 24 or 25 nucleic acid molecules selected from the group consisting of SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77.

In certain embodiments, the methods include determining the expression of the set of nucleic acid molecules or expression products thereof in a non-cancerous tissue sample, and comparing the expression of the set of nucleic acid molecules or expression products thereof in the tissue sample suspected of being cancerous and the non-cancerous tissue sample. In other embodiments, the methods include calculating a ratio of the expression of at least two genes among the set of nucleic acid molecules.

Methods for selecting a course of treatment of a subject having or suspected of having malignant pleural mesothelioma are provided in another aspect of the invention. The methods include obtaining from the subject a tissue sample suspected of being cancerous, determining the expression of a set of nucleic acid markers or expression products thereof which are differentially expressed in malignant pleural mesothelioma tumor tissue samples, and selecting a course of treatment appropriate to the malignant pleural mesothelioma of the subject. In some embodiments the methods also include calculating a ratio of the expression of at least two genes among the set of nucleic acid markers or expression products thereof. In further embodiments, the methods include determining the expression of the set of nucleic acid molecules or expression products thereof in a non-cancerous tissue sample.

In preferred embodiments, the expression of a set of nucleic acid markers is determined by a method selected from the group consisting of nucleic acid hybridization and nucleic acid amplification. More preferably, the nucleic acid hybridization is performed using a solid-phase nucleic acid molecule array, and the the nucleic acid amplification method is real-time PCR.

In another aspect of the invention, methods for evaluating treatment of malignant pleural mesothelioma are provided. The methods include obtaining a first determination of the expression of a set of nucleic acid molecules, or expression products thereof, which are differentially expressed in an malignant pleural mesothelioma tumor tissue sample from a subject undergoing treatment for cancer, obtaining a second determination of the expression of the set of nucleic acid molecules, or expression products thereof, in a second malignant pleural mesothelioma tumor tissue sample from the subject after obtaining the first determination, and comparing the first determination of expression to the second determination of expression as an indication of evaluation of the treatment.

In some embodiments, the determinations of expressions are used to calculate a ratio of gene expression. In other embodiments, the methods include determining the expression of a set of nucleic acid markers which are differentially expressed in non-cancerous tissue samples.

In preferred embodiments, the expression of a set of nucleic acid markers is determined by a method selected from the group consisting of nucleic acid hybridization and nucleic acid amplification. Preferably, the nucleic acid hybridization is performed using a solid-phase nucleic acid molecule array and the nucleic acid amplification method is real-time PCR.

According to a further aspect of the invention, a solid-phase nucleic acid molecule array is provided which consists essentially of at least two nucleic acid molecules selected from the group consisting of SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 fixed to a solid substrate. In some embodiments, the solid-phase nucleic acid molecule array also includes at least one control nucleic acid molecule.

In preferred embodiments, the set of nucleic acid molecules comprises at least 3, 4, 5, 6, 7, 8, 9, 10, 11, 12, 13, 14, 1,5 16, 17, 18, 19, 20, 21, 22, 23, 24, or 25 nucleic acid molecules selected from the group consisting of SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77.

In certain embodiments, the solid substrate comprises a material selected from the group consisting of glass, silica, aluminosilicates, borosilicates, metal oxides such as alumina and nickel oxide, various clays, nitrocellulose, or nylon. In other embodiments, the nucleic acid molecules are fixed to the solid substrate by covalent bonding.

According to still another aspect of the invention, solid-phase protein microarrays are provided that include at least two antibodies or antigen-binding fragments thereof, that specifically bind at least two different polypeptides selected from the group consisting of SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, fixed to a solid substrate.

In some embodiments, the microarray further comprises an antibody or antigen-binding fragment thereof, that binds specifically to a cancer-associated polypeptide other than those selected from the group consisting of SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. In other embodiments, the protein microarray also includes at least one control polypeptide molecule.

In preferred embodiments, the antibodies are monoclonal antibodies, or polyclonal antibodies.

Methods for identifying lead compounds for a pharmacological agent useful in the treatment of malignant pleural mesothelioma are provided in another aspect of the invention. The methods include contacting a malignant pleural mesothelioma cell or tissue with a candidate pharmacological agent, determining the expression of a set of nucleic acid molecules in the malignant pleural mesothelioma cell or tissue sample under conditions which, in the absence of the candidate pharmacological agent, permit a first amount of expression of the set of nucleic acid molecules wherein the set of nucleic acid molecules comprises at least two nucleic acid molecules selected from the group consisting of SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, and detecting a test amount of the expression of the set of nucleic acid molecules, wherein a decrease in the test amount of expression in the presence of the candidate pharmacological agent relative to the first amount of expression indicates that the candidate pharmacological agent is a lead compound for a pharmacological agent which is useful in the treatment of malignant pleural mesothelioma. In preferred embodiments, the methods also include calculating a ratio of gene expression.

These and other aspects of the invention will be described in greater detail below.

BRIEF DESCRIPTION OF THE DRAWING

FIG. 1 shows tumor diagnosis using expression ratios.

FIG. 4 shows the validation of microarray-based analysis of gene expression using real time quantitative RT-PCR.

FIG. 5 depicts prediction of outcome in MPM using expression ratios or tumor histology.

FIG. 6 shows Kaplan-Meier survival predictions for mesothelioma patients and verification of microarray data.

FIG. 7 depicts independent validation of the 4-gene expression ratio model.

DETAILED DESCRIPTION OF THE INVENTION

Figure 1A:
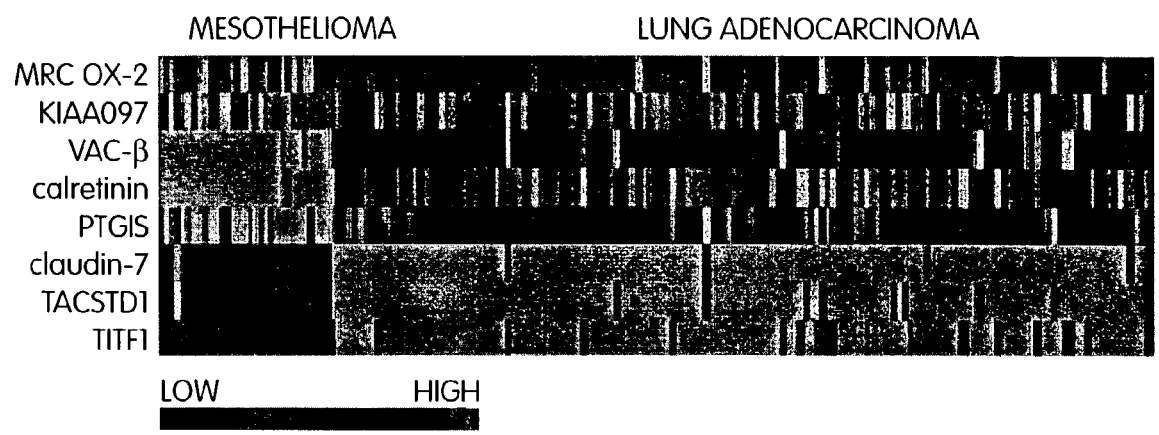
FIG. 1A, patterns of relative expression levels for the 8 genes selected from the training set can be extended to the remaining samples. Relative expression levels increase from low to high per legend.

Gene expression profiling using high density oligonucleotide arrays has figured prominently in recent studies using gene expression patterns in cancer to improve diagnosis and subclassification. Specifically, microarrays have been used to distinguish between acute myeloid leukemia (AML) and acute lymphoblastic leukemia (ALL) (Golub, 1999), to explore molecular differences within the AML group of diseases (Virtaneva, 2001), to identify subclasses of breast cancer (Perou, 2000) and ovarian carcinoma (Welsh, 2001), and to define the metastatic phenotype of melanoma (Clark, 2000).

Although microarray-based analysis of gene expression in cancer has yielded a wealth of information, effective clinical applications have not followed for several reasons. There are no universally accepted and applicable computational methods to analyze microarray data (Quackenbush, 2001). Also, studies utilizing microarrays have lacked a comprehensive clinical database linking patient characteristics to their tumors' gene expression patterns. Furthermore, the prospect of having to use large numbers of genes to diagnose a disease subclass would require a relatively expensive analytical approach such as microarrays. Finally, sophisticated computer algorithms currently used for analysis of microarrays (Quackenbush, 2001; Khan, 2001) have placed the practical use of the resulting data beyond the reach of many biomedical scientists. These limitations were addressed using focused gene expression profiling of MPM in combination with an extensive clinical database to create an unexpectedly simple and effective ratio method with general clinical applicability (i.e., for cancers beyond MPM) for performing relatively low cost diagnosis and prediction of prognosis in cancer.

In contrast to many microarray-based studies seeking to compare gene expression patterns between two or more predefined groups, unsupervised clustering was first used for class discovery in MPM. In this way, the introduction of experimental bias that follows from assuming that tumors of the same histological subtype necessarily possess similar gene expression profiles was avoided. By extension, prognostic genes were identified based on differential expression levels between tumors that were members of the two subclasses with the best and worst prognoses, and not based simply on tumor histology. The fact that the prognostic genes so identified also distinguish epithelial tumors is coincidental, though not surprising since patients with epithelial subtype tumors tend to survive longer than those with mixed subtype tumors.

Subclassification using unsupervised clustering also presents a more biologically relevant organization. It has been shown that similar tumor appearance in itself does not necessitate similar patterns of gene expression nor final clinical outcome. For example, it is not unusual for patients with lung cancers of identical histology, differentiation, location, and stage to have diverging survival (Mountain, 1997). In the experiments described herein, one subclass contained tumors of all three major histological subtypes, suggesting (i) that tumors of diverse appearance are more similar than originally thought, (ii) that all subtypes of MPM are correctly classified as a single disease, and (iii) that histology alone is not sufficient to determine prognosis.

Patient outcome depends on the phenotype of individual tumors at the molecular level, and this is reflected directly in gene expression. The recent explosion of bioinformatics has facilitated exploration of complex patterns of gene expression in human tissues (Fodor, 1997). However, exact relationships between gene expression patterns in cancer and clinical data remain largely undefined. Sophisticated computer algorithms have been recently developed capable of molecular diagnosis of tumors using the immense data sets generated by expression profiling (Khan, 2001). Though valid, the widespread clinical applicability of these techniques in the foreseeable future is questionable. The study described herein shows that diagnosis and prognosis of cancer using data originally obtained from microarrays is not explicitly dependent on the use of increasingly complex technology or complicated methods.

Microarrays themselves are evolving at a rapid pace and gene expression analysis in this manner remains an expensive endeavor. Therefore, comparing historical data to that obtained from new generation microarrays remains a priority for most investigators. Yet there are no satisfactory solutions to date that adequately address all of the normalization issues encountered when attempting to merge data from older microarrays, or those from multiple manufacturers. Examination of ratios of gene expression, as described herein, as opposed to absolute expression levels, also assists in the practical use of data from the older generation of commercially obtained microarrays.

The invention described herein also relates to the identification of a set of genes expressed in cancer tissue that are diagnostic for the cancer and/or predictive of the clinical outcome of the cancer. In one aspect, ratios of gene expression are used as indicia of cancer type, cancer class, and/or cancer prognosis, all of which are useful for determining a course of treatment of a patient.

Changes in cell phenotype in cancer are often the result of one or more changes in the genome expression of the cell. Some genes are expressed in tumor cells, and not in normal cells. Other genes are expressed at higher or lower levels in cancer cells than in normal counterparts. In addition, certain genes are expressed in different levels in different subgroups of cancers, which have different prognoses and require different treatment regimens to optimize patient outcome. The differential expression of such genes can be examined by the assessment of nucleic acid or protein expression in the cancer tissue.

One of the recent developments in gene expression analysis involves the use of microarrays to measure simultaneously the expression of hundreds or thousands of genes. Practical application of this technology requires that researchers or laboratories have a sophisticated knowledge of molecular biology to generated gene expression data, and of computer algorithms for analysis of the large quantities of data generated by the use of the microarrays. The requirements for such knowledge make the use of microarrays impractical in the clinical setting, and difficult even for research laboratories. In addition, one must account for differences in microarray architecture, sample preparation, and analytical equipment that captures the signals from the microarrays.

The use of gene expression ratios in the diagnosis and prediction of prognosis in cancer overcomes several major obstacles to the clinical use of microarray data. The methodology described herein avoids the technical difficulties described above. It generates a simple numerical measure that can be used to predict various aspects of patient clinical data (such as histological subtype and survival) using a single patient biopsy sample. Since this non-linear function of gene expression is a unit-less number, expression levels can be measured using any reliable method such as quantitative RT-PCR or microarrays (nucleic acid or protein) regardless of the type of data capture equipment. Thus, the present invention permits the diagnosis of cancer by clinical laboratories using standard equipment without the requirement for sophisticated data analysis.

Importantly, the diagnostic/prognostic accuracy of ratios permits an earlier definitive diagnosis using initial biopsy samples and reveals important clues about anticipated patient outcome prior to the assignment of treatment strategies. Considering the clinical treatment of MPM, for example, an initial diagnosis is usually made for patients presenting with a malignant pleural effusion. Typically, this diagnosis is confirmed prior to subjecting patients to major surgical resections. Unfortunately, standard pathological techniques for diagnosis even at this point may be inadequate due to a lack of suitable quantities of tissue. As a consequence, the histological subtype of the tumor initially diagnosed may not always be the same as that conclusively determined at the time of surgery (samples analyzed in this study were obtained at surgery when sufficient amount of tissue was available for a definitive pathological diagnosis). This makes it difficult, if not impossible, to stratify treatment based on histological subtyping by prevailing methods. Diagnosis of other cancers is hampered by similar problems. Ratios obtained using tumor tissues taken at the time of initial biopsy can provide a firm diagnosis, determine subclass, and predict outcome after therapy when current pathological techniques are insufficient.

The invention also provides a new, more powerful method of stratifying patients with MPM (and more generally, is applicable to other cancers and other biological states and conditions). It has been previously documented that patients with the epithelial subtype generally enjoy a better prognosis than patients with non-epithelial histology (regardless of treatment strategy) and benefit from aggressive surgical resection. However, this is not an all-inclusive phenomenon; some patients with non-epithelial histology enjoy a longer survival than those with epithelial histology. These factors make it difficult to design clinical studies to explore alternative treatment strategies based on histological subtype.

The results presented herein provide a basis for at least one rational explanation of the aforementioned phenomenon: within MPM, there are actually two classes of epithelial tumors and two classes of mixed tumors. A series of simple tests utilizing ratios of gene expression is proposed that can determine with a high degree of accuracy the correct tumor histological subtype/subclass, and the likely clinical outcome of the patient. This information can be produced from a small tissue biopsy and does not require major surgery. Such classification is useful in the development of meaningful clinical trials in MPM. It therefore can be hypothesized that patients found to have tumors representative of those in Subclass 2 (short-lived mixed subtype) are excellent candidates for neo-adjuvant chemotherapy protocols as they are unlikely to benefit from surgery, whereas patients in Subclasses 1 and 3 are more likely to enjoy long term survival after surgical therapy.

Expression ratios involving two genes that vary in expression between different sample types (e.g., cancer/non-cancer) were used to diagnose and predict prognosis in MPM. Diagnostic and/or prognostic genes in general can be initially identified from microarray analysis and then be tested for clinical relevancy using simpler methods such as RT-PCR. To accomplish similar feats in other biological conditions or states, including other cancers, it may be necessary to use expression ratios including different mathematical combinations and/or more than two genes. The ratio concept described herein (e.g., for clinical use) is simply the relationship between the expression levels of multiple genes that vary in expression between two different sample types, i.e., samples that have different biological properties or were obtained from subjects having different phenotypes, such as cancer/non-cancer phenotypes, responsive/non-responsive to stimuli, susceptible/not susceptible to disease, different metabolic functions, etc. Non-linear unit-less ratios, in any form, can still remain simple if a relatively small number of genes are used in such a way as to not require complex computational software. Therefore, expression ratios of selected genes that vary in expression in two different biological samples may be used to translate complex data sets into simple tests that give clinically useful information for the diagnosis and prediction of prognosis of cancers.

Ratios of gene expression levels can be calculated from expression data of two or more genes at the mRNA level and or protein level. Expression levels of two or more isoforms or variants of the same gene (e.g., splice variants or post-translationally modified variants) also can be used in the ratios. In contrast to prior methods for comparing gene expression, which compared the expression levels of genes relative to an gene having substantially unchanging expression (e.g., a housekeeping gene), the present method compares the expression of two or more genes that differ in expression between two (or more) biological states. Thus in a preferred embodiment, ratios are calculated from expression data of two or more genes, wherein one of the two or more genes is expressed at higher levels in a first biological state relative to the second biological state (upregulated in the first biological state), and a second of the two or more genes is expressed at lower levels in a second biological state relative to the first biological state (downregulated in the first biological state). Examples of this are demonstrated herein, wherein the expression levels of two or more genes that differ in expression in mesothelioma and normal tissue, or in subclasses of mesothelioma, are used to calculate ratios that effectively predict the phenotype of unknown tissue samples.

The ratios can be simple ratios (e.g., x/y) or more complex ratios that include mathematical manipulation of gene expression levels, for example, $(x+a)/(y+b)$ or $x^3/y^3$, wherein x and y represent the expression level data for genes X and Y, and a and b can be either expression level data for genes A and B, or mathematical factors. The use of the ratios is not limited to one set of two genes. Additional sets of genes (two sets, three sets, or more sets) may be required to provide an optimally accurate diagnosis of certain biological states or conditions (e.g., cancers) based on the expression of certain sets of genes. Thus the methods are not limited to a ratio of two genes; a total of 4, 6, or more genes and various ratios of them may be used. Further transformation of the data in the form of multiple gene expression ratios also can be performed. In certain preferred embodiments, the geometric mean of multiple gene ratios is calculated. The expression data used to calculate the ratios may be obtained using any art-known method for analyzing gene expression including microarrays (e.g., standard or custom arrays; nucleic acid, protein or antibody arrays), quantitative RT-PCR, antibody or other immunoassay measurements, etc.

The ratios can be used to diagnose any condition having a genetic component in which two or more genes are differentially expressed in two or more biological states. Conditions include diseases, susceptibility to diseases, metabolic functions (e.g., variability in the metabolism of drugs), response to injury, responses to local cellular environments and the like. In preferred embodiments, the condition is a disease. For example, any diseases that are characterized by (1) the relative increase in the expression of a first gene in a first disease state, and (2) the relative increase in the expression of a second gene in a second disease state or nondisease state, can be diagnosed using ratios of gene expression. Preferred examples of such diseases are cancer, as demonstrated herein for malignant pleural mesothelioma. The ratios of gene expression also can be used to predict a condition outcome or condition prognosis, to monitor onset of a condition, to monitor treatment, and to select a course of treatment for a condition.

The gene expression data for calculation of the ratios may be obtained from analysis of biological samples including tissue, blood, urine, cerebrospinal fluid or other bodily fluids of a subject (e.g., humans or other animals). The expression data can be used without any transformation to calculate a simple ratio of two or more genes as exemplified in the Examples, or data transformation can be applied prior to, or as a part of, calculating the ratios.

The ratio calculation and/or data transformation can be performed by the device that captures the expression data (e.g., a device for performing real-time PCR or a microarray reader), or can be performed by a separate computer running appropriate software.

In certain embodiments, software for calculating ratios as described herein can be provided on a computer connected by data link to a data generating device, such as a microarray reader or PCR machine. Any standard data link can be used, including serial or parallel cables, radio frequency or infrared telemetry links, LAN connections, WAN connections, etc. Alternatively, data can be transferred by computer-readable medium (e.g., magnetic or optical medium) and read by the software. The data also can be entered directly by the user via user interface, such as a keyboard, monitor, mouse, graphical user interface such as touch screen, etc. The computer may be contained within the data generating device, providing an integrated system for generating raw data, calculating ratios, and displaying such ratios. One or more computers also may be linked to one or more data generating devices and one or more display devices, such as in a local area network or wide area network.

After acquiring the raw gene expression data from the data generating device, the data for the variables examined can be used to calculate gene expression ratios in accordance with the methods of the invention. The software can allow the user to select a number of genes preferred for diagnosis or prognosis, or the software may calculate ratios for a standardized set or sets of genes (e.g., genes known to be useful for classification of a tissue type or set of tissue types). The software can execute data transformation algorithms from a preselected group, or can allow the user to input other algorithms. The ratio data can be stored in a data file, printed, and/or directly displayed to the user on a graphical user interface.

In one embodiment of the invention, a visual display is used to display the ratio data for the classification, diagnosis and or prediction of prognosis. The visual display can be a graphical user interface, such as a monitor, or a printer.

The invention also relates to the identification of a set of genes that permit confirmation of the presence of malignant pleural mesothelioma cells in biological samples. Probes for the expression of the genes can be incorporated into a custom array for diagnosis of malignant pleural mesothelioma. The genes identified permit, inter alia, rapid screening of cancer samples by nucleic acid microarray hybridization or protein expression technology to determine the expression of the specific genes and thereby to predict the outcome of the cancer. A microarray also can be used to diagnose malignant pleural mesothelioma, distinguish it from lung cancer (adenocarcinoma and squamous carcinoma), normal lung tissue and/or pleura. One also can use the custom arrays (or standard arrays that contain the genes identified herein) to identify the histological subtype of MPM, the subclass of MPM for determining prognosis. Such screening is beneficial, for example, in selecting the course of treatment to provide to the cancer patient (i.e., directing therapy), and to monitor the efficacy of a treatment.

The invention differs from traditional cancer diagnostic and classification techniques with respect to the speed, simplicity, and reproducibility of the cancer diagnostic assay. The invention also differs from other microarray-based diagnostic methods in that it does not require extensive data analysis or data transformation employing complex algorithms. Further, the invention differs from other cancer diagnostic methods in that it permits accurate diagnosis and classification of tumors by the analysis of a limited set of genes. The use of a limited set of genes in the methods permits the use of simpler methods for acquisition of data, e.g., nucleic acid hybridization based methods such as RT-PCR, that do not generate massive quantities of data from parallel analysis of a large number of genes. The invention also presents targets for drug development because it identifies genes that are differentially expressed in tumors, which can be utilized in the development of drugs to treat such tumors, e.g., by reducing expression of the genes or reducing activity of proteins encoded by the genes.

The invention simplifies prognosis determination by providing an identified set of a small number of genes whose level of expression in malignant pleural mesothelioma predicts clinical outcome as defined by, e.g., patient survival times. In developing the invention, RNA expression phenotyping was performed using high density microarrays generated from quantitative expression data on over 12,000 genes, which have been analyzed to identify specific probe sets (genes). The expression gene set has multifold uses including, but not limited to, the following examples. The expression gene set may be used as a prognostic tool for malignant pleural mesothelioma patients, to make possible more finely tuned diagnosis of malignant pleural mesothelioma and allow healthcare professionals to tailor-treatment to individual patients' needs. The invention can also assess the efficacy of cancer treatment by determining progression or regression of malignant pleural mesothelioma cancer in patients before, during, and after treatment. Another utility of the expression gene set is in the biotechnology and pharmaceutical industries' research on disease pathway discovery for therapeutic targeting. The invention can identify alterations in gene expression in malignant pleural mesothelioma and can also be used to uncover and test candidate pharmaceutical agents to treat malignant pleural mesothelioma.

As used herein, a subject is a human, non-human primate, cow, horse, pig, sheep, goat, dog, cat, or rodent. In all embodiments human subjects are preferred. In aspects of the invention pertaining to diagnosis of malignant pleural mesothelioma, the subject is a human either suspected of having malignant pleural mesothelioma, or having been diagnosed with malignant pleural mesothelioma. In aspects of the invention pertaining to cancer diagnosis in general, using the non-linear methods employing ratios of gene expression described herein, the subject preferably is a human suspected of having cancer, or a human having been previously diagnosed as having cancer. Methods for identifying subjects suspected of having cancer may include physical examination, subject's family medical history, subject's medical history, biopsy, or a number of imaging technologies such as ultrasonography, computed tomography, magnetic resonance imaging, magnetic resonance spectroscopy, or positron emission tomography. Diagnostic methods for cancer and the clinical delineation of cancer diagnoses are well known to those of skill in the medical arts.

As used herein, a tissue sample is tissue obtained from a tissue biopsy using methods well known to those of ordinary skill in the related medical arts. The phrase "suspected of being cancerous" as used herein means a cancer tissue sample believed by one of ordinary skill in the medical arts to contain cancerous cells. Methods for obtaining the sample from the biopsy include gross apportioning of a mass, microdissection, laser-based microdissection, or other art-known cell-separation methods.

Because of the variability of the cell types in diseased-tissue biopsy material, and the variability in sensitivity of the diagnostic methods used, the sample size required for analysis may range from 1, 10, 50, 100, 200, 300, 500, 1000, 5000, 10,000, to 50,000 or more cells. The appropriate sample size may be determined based on the cellular composition and condition of the biopsy and the standard preparative steps for this determination and subsequent isolation of the nucleic acid for use in the invention are well known to one of ordinary skill in the art. An example of this, although not intended to be limiting, is that in some instances a sample from the biopsy may be sufficient for assessment of RNA expression without amplification, but in other instances the lack of suitable cells in a small biopsy region may require use of RNA conversion and/or amplification methods or other methods to enhance resolution of the nucleic acid molecules. Such methods, which allow use of limited biopsy materials, are well known to those of ordinary skill in the art and include, but are not limited to: direct RNA amplification, reverse transcription of RNA to cDNA, amplification of cDNA, or the generation of radio-labeled nucleic acids.

As used herein, the phrase determining the expression of a set of nucleic acid molecules in the tissue means identifying RNA transcripts in the tissue sample by analysis of nucleic acid or protein expression in the tissue sample. As used herein for diagnosis of MPM and/or determination of outcome of MPM patients, "set" refers to a group of nucleic acid molecules that include 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 different nucleic acid sequences from the group of 26 nucleic acid sequences in Table 1 (SEQ ID NOs: 9, 11, 13, 15, 17, 19, 21, 23, 25, 27, 29, 31, 33, 35, 37, 39, 41, 43, 45, 47, 49, 51, 53, 55, 57 and 59) and/or from the group of 11 nucleic acid sequences in Table 3 (SEQ ID Nos: 43, 45, 61, 63, 65, 67, 69, 71, 73, 75 and 77). Other sets will be used for other malignacies or other disorders to determine gene ratios for diagnosis, outcome determination and the like; some of these data sets are described in the Examples below.

The expression of the set of nucleic acid molecules in the sample from the patient suspected of having malignant pleural mesothelioma can be compared to the expression of the set of nucleic acid molecules in a sample of tissue that is non-cancerous. As used herein with respect to diagnosis of malignant pleural mesothelioma, non-cancerous tissue means tissue determined by one of ordinary skill in the medical art to have no evidence of malignant pleural mesothelioma based on standard diagnostic methods including, but not limited to, histologic staining and microscopic analysis.

Nucleic acid markers for cancer are nucleic acid molecules that by their presence or absence indicate the presence of absence of malignant pleural mesothelioma. In tissue, certain nucleic acid molecules are expressed at different levels depending on whether tissue is non-cancerous or cancerous.

Hybridization methods for nucleic acids are well known to those of ordinary skill in the art (see, e.g. *Molecular Cloning: A Laboratory Manual*, J. Sambrook, et al., eds., Second Edition, Cold Spring Harbor Laboratory Press, Cold Spring Harbor, N.Y., 1989, or *Current Protocols in Molecular Biology*, F. M. Ausubel, et al., eds., John Wiley & Sons, Inc., New York). The nucleic acid molecules from a malignant pleural mesothelioma tissue sample hybridize under stringent conditions to nucleic acid markers expressed in malignant pleural mesothelioma. In one embodiment the markers are sets of two or more of the nucleic acid molecules as set forth in Table 1 (SEQ ID NOs: 9, 11, 13, 15, 17, 19, 21, 23, 25, 27, 29, 31, 33, 35, 37, 39, 41, 43, 45, 47, 49, 51, 53, 55, 57 and 59) or Table 3 (SEQ ID Nos: 43, 45, 61, 63, 65, 67, 69, 71, 73, 75, 77).

The malignant pleural mesothelioma nucleic acid markers disclosed herein are known genes and fragments thereof. It may be desirable to identify variants of those genes, such as allelic variants or single nucleotide polymorphisms (SNPs) in tissues. Accordingly, methods for identifying malignant pleural mesothelioma nucleic acid markers, including variants of the disclosed full-length cDNAs, genomic DNAs, and SNPs are also included in the invention. The methods include contacting a nucleic acid sample (such as a cDNA library, genomic library, genomic DNA isolate, etc.) with a nucleic acid probe or primer derived from one of SEQ ID NOs: 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. The nucleic acid sample and the probe or primer hybridize to complementary nucleotide sequences of nucleic acids in the sample, if any are present, allowing detection of nucleic acids related to SEQ ID NOs: 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. Preferably the probe or primer is detectably labeled. The specific conditions, reagents, and the like can be selected by one of ordinary skill in the art to selectively identify nucleic acids related to sets of two or more of SEQ ID NOs: 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77. The isolated nucleic acid molecule can be sequenced according to standard procedures.

In addition to native nucleic acid markers (SEQ ID NOs: 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77), the invention also includes degenerate nucleic acids that include alternative codons to those present in the native materials. For example, serine residues are encoded by the codons TCA, AGT, TCC, TCG, TCT, and AGC. Each of the six codons is equivalent for the purposes of encoding a serine residue. Similarly, nucleotide sequence triplets that encode other amino acid residues include, but are not limited to: CCA, CCC, CCG, and CCT (proline codons); CGA, CGC, CGG, CGT, AGA, and AGG (arginine codons); ACA, ACC, ACG, and ACT (threonine codons); AAC and AAT (asparagine codons); and ATA, ATC, and ATT (isoleucine codons). Other amino acid residues may be encoded similarly by multiple nucleotide sequences. Thus, the invention embraces degenerate nucleic acids that differ from the biologically isolated nucleic acids in codon sequence due to the degeneracy of the genetic code.

The invention also provides modified nucleic acid molecules, which include additions, substitutions, and deletions of one or more nucleotides such as the allelic variants and SNPs described above. In preferred embodiments, these modified nucleic acid molecules and/or the polypeptides they encode retain at least one activity or function of the unmodified nucleic acid molecule and/or the polypeptides, such as hybridization, antibody binding, etc. In certain embodiments, the modified nucleic acid molecules encode modified polypeptides, preferably polypeptides having conservative amino acid substitutions. As used herein, a "conservative amino acid substitution" refers to an amino acid substitution which does not alter the relative charge or size characteristics of the protein in which the amino acid substitution is made. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D. The modified nucleic acid molecules are structurally related to the unmodified nucleic acid molecules and in preferred embodiments are sufficiently structurally related to the unmodified nucleic acid molecules so that the modified and unmodified nucleic acid molecules hybridize under stringent conditions known to one of skill in the art.

For example, modified nucleic acid molecules that encode polypeptides having single amino acid changes can be prepared for use in the methods and products disclosed herein. Each of these nucleic acid molecules can have one, two, or three nucleotide substitutions exclusive of nucleotide changes corresponding to the degeneracy of the genetic code as described herein. Likewise, modified nucleic acid molecules that encode polypeptides having two amino acid changes can be prepared, which have, e.g., 2-6 nucleotide changes. Numerous modified nucleic acid molecules like these will be readily envisioned by one of skill in the art, including for example, substitutions of nucleotides in codons encoding amino acids 2 and 3, 2 and 4, 2 and 5, 2 and 6, and so on. In the foregoing example, each combination of two amino acids is included in the set of modified nucleic acid molecules, as well as all nucleotide substitutions that code for the amino acid substitutions. Additional nucleic acid molecules that encode polypeptides having additional substitutions (i.e., 3 or more), additions or deletions [e.g., by introduction of a stop codon or a splice site(s)] also can be prepared and are embraced by the invention as readily envisioned by one of ordinary skill in the art. Any of the foregoing nucleic acids can be tested by routine experimentation for retention of structural relation to or activity similar to the nucleic acids disclosed herein.

In the invention, standard hybridization techniques of microarray technology are utilized to assess patterns of nucleic acid expression and identify nucleic acid marker expression. Microarray technology, which is also known by other names including: DNA chip technology, gene chip technology, and solid-phase nucleic acid array technology, is well known to those of ordinary skill in the art and is based on, but not limited to, obtaining an array of identified nucleic acid probes on a fixed substrate, labeling target molecules with reporter molecules (e.g., radioactive, chemiluminescent, or fluorescent tags such as fluorescein, Cye3-dUTP, or Cye5-dUTP), hybridizing target nucleic acids to the probes, and evaluating target-probe hybridization. A probe with a nucleic acid sequence that perfectly matches the target sequence will, in general, result in detection of a stronger reporter-molecule signal than will probes with less perfect matches. Many components and techniques utilized in nucleic acid microarray technology are presented in *The Chipping Forecast*, Nature Genetics, Vol.21, Jan 1999, the entire contents of which is incorporated by reference herein.

According to the present invention, microarray substrates may include but are not limited to glass, silica, aluminosilicates, borosilicates, metal oxides such as alumina and nickel oxide, various clays, nitrocellulose, or nylon. In all embodiments a glass substrate is preferred. According to the invention, probes are selected from the group of nucleic acids including, but not limited to: DNA, genomic DNA, cDNA, and oligonucleotides; and may be natural or synthetic. Oligonucleotide probes preferably are 20 to 25-mer oligonucleotides and DNA/cDNA probes preferably are 500 to 5000 bases in length, although other lengths may be used. Appropriate probe length may be determined by one of ordinary skill in the art by following art-known procedures. In one embodiment, preferred probes are sets of two or more of the nucleic acid molecules set forth as SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (see also Table 1 and Table 3). Probes may be purified to remove contaminants using standard methods known to those of ordinary skill in the art such as gel filtration or precipitation.

In one embodiment, the microarray substrate may be coated with a compound to enhance synthesis of the probe on the substrate. Such compounds include, but are not limited to, oligoethylene glycols. In another embodiment, coupling agents or groups on the substrate can be used to covalently link the first nucleotide or oligonucleotide to the substrate. These agents or groups may include, but are not limited to: amino, hydroxy, bromo, and carboxy groups. These reactive groups are preferably attached to the substrate through a hydrocarbyl radical such as an alkylene or phenylene divalent radical, one valence position occupied by the chain bonding and the remaining attached to the reactive groups. These hydrocarbyl groups may contain up to about ten carbon atoms, preferably up to about six carbon atoms. Alkylene radicals are usually preferred containing two to four carbon atoms in the principal chain. These and additional details of the process are disclosed, for example, in U.S. Pat. No. 4,458, 066, which is incorporated by reference in its entirety.

In one embodiment, probes are synthesized directly on the substrate in a predetermined grid pattern using methods such as light-directed chemical synthesis, photochemical deprotection, or delivery of nucleotide precursors to the substrate and subsequent probe production.

In another embodiment, the substrate may be coated with a compound to enhance binding of the probe to the substrate. Such compounds include, but are not limited to: polylysine, amino silanes, amino-reactive silanes (*Chipping Forecast*, 1999) or chromium (Gwynne and Page, 2000). In this embodiment, presynthesized probes are applied to the substrate in a precise, predetermined volume and grid pattern, utilizing a computer-controlled robot to apply probe to the substrate in a contact-printing manner or in a non-contact manner such as ink jet or piezo-electric delivery. Probes may be covalently linked to the substrate with methods that include, but are not limited to, UV-irradiation. In another embodiment probes are linked to the substrate with heat.

Targets are nucleic acids selected from the group, including but not limited to: DNA, genomic DNA, cDNA, RNA, mRNA and may be natural or synthetic. In all embodiments, nucleic acid molecules from human tissue are preferred. The tissue may be obtained from a subject or may be grown in culture (e.g., from a malignant pleural mesothelioma cell line).

In embodiments of the invention one or more control nucleic acid molecules are attached to the substrate. Preferably, control nucleic acid molecules allow determination of factors including but not limited to: nucleic acid quality and binding characteristics; reagent quality and effectiveness; hybridization success; and analysis thresholds and success. Control nucleic acids may include but are not limited to expression products of genes such as housekeeping genes or fragments thereof.

In one embodiment of the invention, expression of nucleic acid markers is used to select clinical treatment paradigms for cancers, such as malignant pleural mesothelioma. Treatment options, as described herein, may include but are not limited to: radiotherapy, chemotherapy, adjuvant therapy, or any combination of the aforementioned methods. Aspects of treatment that may vary include, but are not limited to: dosages, timing of administration, or duration or therapy; and may or may not be combined with other treatments, which may also vary in dosage, timing, or duration. Another treatment for malignant pleural mesothelioma is surgery, which can be utilized either alone or in combination with any of the aforementioned treatment methods. One of ordinary skill in the medical arts may determine an appropriate treatment paradigm based on evaluation of differential expression of sets of two or more genes, such as those set forth as SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 for malignant pleural mesothelioma. Cancers that express markers that are indicative of a more aggressive cancer or poor prognosis may be treated with more aggressive therapies.

Progression or regression of malignant pleural mesothelioma is determined by comparison of two or more different malignant pleural mesothelioma tissue samples taken at two or more different times from a subject. For example, progression or regression may be evaluated by assessments of expression of sets of two or more of the nucleic acid targets, preferably using ratios of expression, including but not limited to SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, in an malignant pleural mesothelioma tissue sample from a subject before, during, and following treatment for malignant pleural mesothelioma. Progression or regression or other cancers or disease states would be determined similarly.

In another embodiment, novel pharmacological agents useful in the treatment of malignant pleural mesothelioma can be identified by assessing variations in the expression of sets of two or more malignant pleural mesothelioma nucleic acid markers (preferably, variations in the ratios of expression), from among SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, prior to and after contacting malignant pleural mesothelioma cells or tissues with candidate pharmacological agents for the treatment of malignant pleural mesothelioma. The cells may be grown in culture (e.g. from an malignant pleural mesothelioma cell line), or may be obtained from a subject, (e.g. in a clinical trial of candidate pharmaceutical agents to treat malignant pleural mesothelioma). Alterations in expression of two or more sets of nucleic acid markers, from among SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, in malignant pleural mesothelioma cells or tissues tested before and after contact with a candidate pharmacological agent to treat malignant pleural mesothelioma, indicate progression, regression, or stasis of the malignant pleural mesothelioma thereby indicating efficacy of candidate agents and concomitant identification of lead compounds for therapeutic use in malignant pleural mesothelioma.

The invention further provides efficient methods of identifying pharmacological agents or lead compounds for agents active at the level of malignant pleural mesothelioma cellular function. Generally, the screening methods involve assaying for compounds that beneficially alter malignant pleural mesothelioma nucleic acid molecule expression. Such methods are adaptable to automated, high-throughput screening of compounds.

The assay mixture comprises a candidate pharmacological agent. Typically, a plurality of assay mixtures are run in parallel with different agent concentrations to obtain a different response to the various concentrations. Typically, one of these concentrations serves as a negative control, i.e., at zero concentration of agent or at a concentration of agent below the limits of assay detection. Candidate agents encompass numerous chemical classes, although typically they are organic compounds. Preferably, the candidate pharmacological agents are small organic compounds, i.e., those having a molecular weight of more than 50 yet less than about 2500, preferably less than about 1000 and, more preferably, less than about 500. Candidate agents comprise functional chemical groups necessary for structural interactions with polypeptides and/or nucleic acids, and typically include at least an amine, carbonyl, hydroxyl, or carboxyl group, preferably at least two of the functional chemical groups and more preferably at least three of the functional chemical groups. The candidate agents can comprise cyclic carbon or heterocyclic structure and/or aromatic or polyaromatic structures substituted with one or more of the above-identified functional groups. Candidate agents also can be biomolecules such as peptides, saccharides, fatty acids, sterols, isoprenoids, purines, pyrimidines, derivatives or structural analogs of the above, or combinations thereof and the like. Where the agent is a nucleic acid, the agent typically is a DNA or RNA molecule, although modified nucleic acids as defined herein are also contemplated.

Candidate agents are obtained from a wide variety of sources including libraries of synthetic or natural compounds. For example, numerous means are available for random and directed synthesis of a wide variety of organic compounds and biomolecules, including expression of randomized oligonucleotides, synthetic organic combinatorial libraries, phage display libraries of random peptides, and the like. Alternatively, libraries of natural compounds in the form of bacterial, fungal, plant, and animal extracts are available or readily produced. Additionally, natural and synthetically produced libraries and compounds can be readily be modified through conventional chemical, physical, and biochemical means. Further, known pharmacological agents may be subjected to directed or random chemical modifications such as acylation, alkylation, esterification, amidification, etc. to produce structural analogs of the agents.

A variety of other reagents also can be included in the mixture. These include reagents such as salts, buffers, neutral proteins (e.g., albumin), detergents, etc. which may be used to facilitate optimal protein-protein and/or protein-nucleic acid binding. Such a reagent may also reduce non-specific or background interactions of the reaction components. Other reagents that improve the efficiency of the assay such as protease, inhibitors, nuclease inhibitors, antimicrobial agents, and the like may also be used.

The mixture of the foregoing assay materials is incubated under conditions whereby, the anti-cancer candidate agent specifically binds the cellular binding target, a portion thereof or analog thereof. The order of addition of components, incubation temperature, time of incubation, and other parameters of the assay may be readily determined. Such experimentation merely involves optimization of the assay parameters, not the fundamental composition of the assay. Incubation temperatures typically are between 4° C. and 40° C. Incubation times preferably are minimized to facilitate rapid, high throughput screening, and typically are between 0.1 and 10 hours.

After incubation, the presence or absence of specific binding between the anti-malignant pleural mesothelioma candidate agent and one or more binding targets is detected by any convenient method available to the user. For cell-free binding type assays, a separation step is often used to separate bound from unbound components. The separation step may be accomplished in a variety of ways. Conveniently, at least one of the components is immobilized on a solid substrate, from which the unbound components may be easily separated. The solid substrate can be made of a wide variety of materials and in a wide variety of shapes, e.g., microtiter plate, microbead, dipstick, resin particle, etc. The substrate preferably is chosen to maximize signal-to-noise ratios, primarily to minimize background binding, as well as for ease of separation and cost.

Separation may be effected for example, by removing a bead or dipstick from a reservoir, emptying or diluting a reservoir such as a microtiter plate well, rinsing a bead, particle, chromotographic column or filter with a wash solution or solvent. The separation step preferably includes multiple rinses or washes. For example, when the solid substrate is a microtiter plate, the wells may be washed several times with a washing solution, which typically includes those components of the incubation mixture that do not participate in specific bindings such as salts, buffer, detergent, non-specific protein, etc. Where the solid substrate is a magnetic bead, the beads may be washed one or more times with a washing solution and isolated using a magnet.

Detection may be effected in any convenient way for cell-based assays such as two- or three-hybrid screens. The transcript resulting from a reporter gene transcription assay of the anti-cancer agent binding to a target molecule typically encodes a directly or indirectly detectable product, e.g., β-galactosidase activity, luciferase activity, and the like. For cell-free binding assays, one of the components usually comprises, or is coupled to, a detectable label. A wide variety of labels can be used, such as those that provide direct detection (e.g., radioactivity, luminescence, optical, or electron density, etc) or indirect detection (e.g., epitope tag such as the FLAG epitope, enzyme tag such as horseseradish peroxidase, etc.). The label may be bound to an anti-cancer agent binding partner, or incorporated into the structure of the binding partner.

A variety of methods may be used to detect the label, depending on the nature of the label and other assay components. For example, the label may be detected while bound to the solid substrate or subsequent to separation from the solid substrate. Labels may be directly detected through optical or electron density, radioactive emissions, nonradiative energy transfers, etc. or indirectly detected with antibody conjugates, strepavidin-biotin conjugates, etc. Methods for detecting the labels are well known in the art.

The invention thus generally provides cancer gene- or protein-specific binding agents, methods of identifying and making such agents, and their use in diagnosis, therapy and pharmaceutical development. For example, malignant pleural mesothelioma gene- or protein-specific pharmacological agents are useful in a variety of diagnostic and therapeutic applications as described herein. In general, the specificity of an cancer gene or protein binding to a binding agent is shown by binding equilibrium constants. Targets that are capable of selectively binding an cancer gene preferably have binding equilibrium constants of at least about $10^7$ $M^{-1}$, more preferably at least about $10^8$ $M^{-1}$, and most preferably at least about $10^9$ $M^{-1}$. The wide variety of cell-based and cell-free assays may be used to demonstrate cancer gene-specific binding. Cell-based assays include one, two and three hybrid screens, assays in which cancer gene-mediated transcription is inhibited or increased, etc. Cell-free assays include cancer gene-protein binding assays, immunoassays, etc. Other assays useful for screening agents which bind cancer polypeptides include fluorescence resonance energy transfer (FRET), and electrophoretic mobility shift analysis (EMSA).

In another aspect of the invention, pre- and post-treatment alterations in expression of two or more sets of cancer nucleic acid markers, for example malignant pleural mesothelioma cancer nucleic acid markers including, but not limited to, SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, in cancer cells or tissues may be used to assess treatment parameters including, but not limited to: dosage, method of administration, timing of administration, and combination with other treatments as described herein.

Candidate pharmacological agents may include antisense oligonucleotides that selectively bind to a cancer-related nucleic acid marker molecule, as identified herein, to reduce the expression of the marker molecules in cancer cells and tissues. One of ordinary skill in the art can test of the effects of a reduction of expression of cancer nucleic acid marker sequences in vivo or in vitro, to determine the efficacy of one or more antisense oligonucleotides.

As used herein, the term "antisense oligonucleotide" or "antisense" describes an oligonucleotide that is an oligoribonucleotide, oligodeoxyribonucleotide, modified oligoribonucleotide, or modified oligodeoxyribonucleotide, which hybridizes under physiological conditions to DNA comprising a particular gene or to an mRNA transcript of that gene and, thereby, inhibits the transcription of that gene and/or the translation of that mRNA. The antisense molecules are designed so as to interfere with transcription or translation of a target gene upon hybridization with the target gene or transcript. Those skilled in the art will recognize that the exact length of the antisense oligonucleotide and its degree of complimentarily with its target will depend upon the specific target selected, including the sequence of the target and the particular bases which comprise that sequence. It is preferred that the antisense oligonucleotide be constructed and arranged so as to bind selectively with the target under physiological conditions, i.e., to hybridize substantially more to the target sequence than to any other sequence in the target cell under physiological conditions.

Based upon the sequences of cancer expressed nucleic acids, or upon allelic or homologous genomic and/or cDNA sequences, one of skill in the art can easily choose and synthesize any of a number of appropriate antisense molecules for use in accordance with the present invention. In order to be sufficiently selective and potent for inhibition, such antisense oligonucleotides should comprise at least 10 and, more preferably, at least 15 consecutive bases that are complementary to the target, although in certain cases modified oligonucleotides as short as 7 bases in length have been used successfully as antisense oligonucleotides (Wagner et al., 1996).

Most preferably, the antisense oligonucleotides comprise a complementary sequence of 20-30 bases. Although oligonucleotides may be chosen that are antisense to any region of the gene or mRNA transcripts, in preferred embodiments the antisense oligonucleotides correspond to N-terminal or 5' upstream sites such as translation initiation, transcription initiation, or promoter sites. In addition, 3'-untranslated regions may be targeted. Targeting to mRNA splicing sites has also been used in the art but may be less preferred if alternative mRNA splicing occurs. In addition, the antisense is targeted, preferably, to sites in which mRNA secondary structure is not expected (see, e.g., Sainio et al., 1994) and at which proteins are not expected to bind. Finally, although the listed sequences are cDNA sequences, one of ordinary skill in the art may easily derive the genomic DNA corresponding to the cDNA of an cancer expressed polypeptide. Thus, the present invention also provides for antisense oligonucleotides that are complementary to the genomic DNA corresponding to cancer expressed nucleic acids, e.g, the malignant pleural mesothelioma nucleic acid markers described herein. Similarly, the use of antisense to allelic or homologous cDNAs and genomic DNAs are enabled without undue experimentation.

In one set of embodiments, the antisense oligonucleotides of the invention may be composed of "natural" deoxyribonucleotides, ribonucleotides, or any combination thereof. That is, the 5' end of one native nucleotide and the 3' end of another native nucleotide may be covalently linked, as in natural systems, via a phosphodiester internucleoside linkage. These oligonucleotides may be prepared by art-recognized methods, which may be carried out manually or by an automated synthesizer. They also may be produced recombinantly by vectors.

In preferred embodiments, however, the antisense oligonucleotides of the invention also may include "modified" oligonucleotides. That is, the oligonucleotides may be modified in a number of ways that do not prevent them from hybridizing to their target but which enhance their stability or targeting or which otherwise enhance their therapeutic effectiveness. The term "modified oligonucleotide" as used herein describes an oligonucleotide in which (1) at least two of its nucleotides are covalently linked via a synthetic internucleoside linkage (i.e., a linkage other than a phosphodiester linkage between the 5' end of one nucleotide and the 3' end of another nucleotide) and/or (2) a chemical group not normally associated with nucleic acids has been covalently attached to the oligonucleotide. Preferred synthetic internucleoside linkages are phosphorothioates, alkylphosphonates, phosphorodithioates, phosphate esters, alkylphosphonothioates, phosphoramidates, carbamates, carbonates, phosphate triesters, acetamidates, carboxymethyl esters, and peptides.

The term "modified oligonucleotide" also encompasses oligonucleotides with a covalently modified base and/or sugar. For example, modified oligonucleotides include oligonucleotides having backbone sugars that are covalently attached to low molecular weight organic groups other than a hydroxyl group at the 3' position and other than a phosphate group at the 5' position. Thus modified oligonucleotides may include a 2'-O-alkylated ribose group. In addition, modified oligonucleotides may include sugars such as arabinose instead of ribose. The present invention, thus, contemplates pharmaceutical preparations containing modified antisense molecules that are complementary to and hybridizable with, under physiological conditions, malignant pleural mesothelioma expressed nucleic acids, together with pharmaceutically acceptable carriers.

Antisense oligonucleotides may be administered as part of a pharmaceutical composition. Such a pharmaceutical composition may include the antisense oligonucleotides in combination with any standard physiologically and/or pharmaceutically acceptable carriers which are known in the art. The compositions should be sterile and contain a therapeutically effective amount of the antisense oligonucleotides in a unit of weight or volume suitable for administration to a patient. The term "pharmaceutically acceptable" means a non-toxic material that does not interfere with the effectiveness of the biological activity of the active ingredients. The term "physiologically acceptable" refers to a non-toxic material that is compatible with a biological system such as a cell, cell culture, tissue, or organism. The characteristics of the carrier will depend on the route of administration. Physiologically and pharmaceutically acceptable carriers include diluents, fillers, salts, buffers, stabilizers, solubilizers, and other materials, which are well known in the art.

Expression of cancer nucleic acid molecules can also be determined using protein measurement methods, e.g., for use in the ratio-based diagnostic and prognostic methods described herein. For example, the expression of malignant pleural mesothelioma genes such as SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, can be determined by examining the expression of polypeptides encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (exemplary translations are provided herein as SEQ ID NOs: 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78). Preferred methods of specifically and quantitatively measuring proteins include, but are not limited to: mass spectroscopy-based methods such as surface enhanced laser desorption ionization (SELDI; e.g., Ciphergen ProteinChip System), non-mass spectroscopy-based methods, immunoassay methods such as ELISA and immunohistochemistry-based methods such as 2-dimensional gel electrophoresis.

SELDI methodology may, through procedures known to those of ordinary skill in the art, be used to vaporize microscopic amounts of tumor protein and to create a "fingerprint" of individual proteins, thereby allowing simultaneous measurement of the abundance of many proteins in a single sample. Preferably SELDI-based assays may be utilized to classify tumors. Such assays preferably include, but are not limited to the following examples. Gene products discovered by RNA microarrays may be selectively measured by specific (antibody mediated) capture to the SELDI protein disc (e.g., selective SELDI). Gene products discovered by protein screening (e.g., with 2-D gels), may be resolved by "total protein SELDI" optimized to visualize those particular markers of interest from among polypeptides encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78). Predictive models of tumor classification from SELDI measurement of multiple markers from among polypeptides encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78) may be utilized for the SELDI strategies.

The invention also involves agents such as polypeptides that bind to malignant pleural mesothelioma-associated polypeptides, e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78. Such binding agents can be used, for example, in screening assays to detect the presence or absence of malignant pleural mesothelioma-associated polypeptides and complexes of malignant pleural mesothelioma-associated polypeptides and their binding partners and in purification protocols to isolate malignant pleural mesothelioma-associated polypeptides and complexes of malignant pleural mesothelioma-associated polypeptides and their binding partners. Such agents also may be used to inhibit the native activity of the malignant pleural mesothelioma-associated polypeptides, for example, by binding to such polypeptides.

The invention, therefore, embraces peptide binding agents which, for example, can be antibodies or fragments of antibodies having the ability to selectively bind to malignant pleural mesothelioma-associated polypeptides. Antibodies include polyclonal and monoclonal antibodies, prepared according to conventional methodology.

Significantly, as is well-known in the art, only a small portion of an antibody molecule, the paratope, is involved in the binding of the antibody to its epitope (see, in general, Clark, W. R. (1986) *The Experimental Foundations of Modern Immunology* Wiley & Sons, Inc., New York; Roitt, I. (1991) *Essential Immunology*, 7th Ed., Blackwell Scientific Publications, Oxford). The pFc' and Fc regions, for example, are effectors of the complement cascade but are not involved in antigen binding. An antibody from which the pFc' region has been enzymatically cleaved, or which has been produced without the pFc' region, designated an $F(ab')_2$ fragment, retains both of the antigen binding sites of an intact antibody. Similarly, an antibody from which the Fc region has been enzymatically cleaved, or which has been produced without the Fc region, designated an Fab fragment, retains one of the antigen binding sites of an intact antibody molecule. Proceeding further, Fab fragments consist of a covalently bound antibody light chain and a portion of the antibody heavy chain denoted Fd. The Fd fragments are the major determinant of antibody specificity (a single Fd fragment may be associated with up to ten different light chains without altering antibody specificity) and Fd fragments retain epitope-binding ability in isolation.

Within the antigen-binding portion of an antibody, as is well-known in the art, there are complementarity determining regions (CDRs), which directly interact with the epitope of the antigen, and framework regions (FRs), which maintain the tertiary structure of the paratope (see, in general, Clark, 1986; Roitt, 1991). In both the heavy chain Fd fragment and the light chain of IgG immunoglobulins, there are four framework regions (FR1 through FR4) separated respectively by three complementarity determining regions (CDR1 through CDR3). The CDRs, and in particular the CDR3 regions, and more particularly the heavy chain CDR3, are largely responsible for antibody specificity.

It is now well-established in the art that the non-CDR regions of a mammalian antibody may be replaced with similar regions of conspecific or heterospecific antibodies while retaining the epitopic specificity of the original antibody. This is most clearly manifested in the development and use of "humanized" antibodies in which non-human CDRs are covalently joined to human FR and/or Fc/pFc' regions to produce a functional antibody. See, e.g., U.S. Pat. Nos. 4,816, 567, 5,225,539, 5,585,089, 5,693,762 and 5,859,205.

Fully human monoclonal antibodies also can be prepared by immunizing mice transgenic for large portions of human immunoglobulin heavy and light chain loci. Following immunization of these mice (e.g., XenoMouse (Abgenix), HuMAb mice (Medarex/GenPharm)), monoclonal antibodies can be prepared according to standard hybridoma technology. These monoclonal antibodies will have human immunoglobulin amino acid sequences and therefore will not provoke human anti-mouse antibody (HAMA) responses when administered to humans.

Thus, as will be apparent to one of ordinary skill in the art, the present invention also provides for F(ab')$_2$, Fab, Fv and Fd fragments; chimeric antibodies in which the Fc and/or FR and/or CDR1 and/or CDR2 and/or light chain CDR3 regions have been replaced by homologous human or non-human sequences; chimeric F(ab')$_2$ fragment antibodies in which the FR and/or CDR1 and/or CDR2 and/or light chain CDR3 regions have been replaced by homologous human or non-human sequences; chimeric Fab fragment antibodies in which the FR and/or CDR1 and/or CDR2 and/or light chain CDR3 regions have been replaced by homologous human or non-human sequences; and chimeric Fd fragment antibodies in which the FR and/or CDR1 and/or CDR2 regions have been replaced by homologous human or non-human sequences. The present invention also includes so-called single chain antibodies.

Thus, the invention involves the use of polypeptides of numerous size and type that bind specifically to polypeptides selected from those encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78), and complexes of both malignant pleural mesothelioma-associated polypeptides and their binding partners. These polypeptides may be derived also from sources other than antibody technology. For example, such polypeptide binding agents can be provided by degenerate peptide libraries which can be readily prepared in solution, in immobilized form or as phage display libraries. Combinatorial libraries also can be synthesized of peptides containing one or more amino acids. Libraries further can be synthesized of peptoids and non-peptide synthetic moieties.

Phage display can be particularly effective in identifying binding peptides useful according to the invention. Briefly, one prepares a phage library (using e.g. m13, fd, or lambda phage), displaying inserts from 4 to about 80 amino acid residues using conventional procedures. The inserts may represent, for example, a completely degenerate or biased array. One then can select phage-bearing inserts which bind to the malignant pleural mesothelioma-associated polypeptide. This process can be repeated through several cycles of reselection of phage that bind to the malignant pleural mesothelioma-associated polypeptide. Repeated rounds lead to enrichment of phage bearing particular sequences. DNA sequence analysis can be conducted to identify the sequences of the expressed polypeptides. The minimal linear portion of the sequence that binds to the malignant pleural mesothelioma-associated polypeptide can be determined. One can repeat the procedure using a biased library containing inserts containing part or all of the minimal linear portion plus one or more additional degenerate residues upstream or downstream thereof. Yeast two-hybrid screening methods also may be used to identify polypeptides that bind to the malignant pleural mesothelioma-associated polypeptides.

Thus, the malignant pleural mesothelioma-associated polypeptides of the invention, including fragments thereof, can be used to screen peptide libraries, including phage display libraries, to identify and select peptide binding partners of the malignant pleural mesothelioma-associated polypeptides of the invention. Such molecules can be used, as described herein, for screening assays, for purification protocols, for interfering directly with the functioning of malignant pleural mesothelioma-associated polypeptides and for other purposes that will be apparent to those of ordinary skill in the art. For example, isolated malignant pleural mesothelioma-associated polypeptides can be attached to a substrate (e.g., chromatographic media, such as polystyrene beads, a filter, or an array substrate), and then a solution suspected of containing the binding partner may be applied to the substrate. If a binding partner that can interact with malignant pleural mesothelioma-associated polypeptides is present in the solution, then it will bind to the substrate-malignant pleural mesothelioma-associated polypeptide. The binding partner then may be isolated.

As detailed herein, the foregoing antibodies and other binding molecules may be used for example, to identify tissues expressing protein or to purify protein. Antibodies also may be coupled to specific diagnostic labeling agents for imaging of cells and tissues that express malignant pleural mesothelioma-associated polypeptides or to therapeutically useful agents according to standard coupling procedures. Diagnostic agents include, but are not limited to, barium sulfate, iocetamic acid, iopanoic acid, ipodate calcium, diatrizoate sodium, diatrizoate meglumine, metrizamide, tyropanoate sodium and radiodiagnostics including positron emitters such as fluorine-18 and carbon-11, gamma emitters such as iodine-123, technitium-99m, iodine-131 and indium-111, nuclides for nuclear magnetic resonance such as fluorine and gadolinium.

The invention further includes protein microarrays for analyzing expression of malignant pleural mesothelioma-associated peptides selected from those encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78). In this aspect of the invention, standard techniques of microarray technology are utilized to assess expression of the malignant pleural mesothelioma-associated polypeptides and/or identify biological constituents that bind such polypeptides. The constituents of biological samples include antibodies, lymphocytes (particularly T lymphocytes), and the like. Protein microarray technology, which is also known by other names including: protein chip technology and solid-phase protein array technology, is well known to those of ordinary skill in the art and is based on, but not limited to, obtaining an array of identified peptides or proteins on a fixed substrate, binding target molecules or biological constituents to the peptides, and evaluating such binding. See, e.g., G. MacBeath and S. L. Schreiber, "Printing Proteins as Microarrays for High-Throughput Function Determination," *Science* 289(5485):1760-1763, 2000.

Preferably antibodies or antigen binding fragments thereof that specifically bind polypeptides selected from the group consisting of those encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78) are attached to the microarray substrate in accordance with standard attachment methods known in the art. These arrays can be used to quantify the expression of the polypeptides identified herein.

In some embodiments of the invention, one or more control peptide or protein molecules are attached to the substrate. Preferably, control peptide or protein molecules allow determination of factors such as peptide or protein quality and binding characteristics, reagent quality and effectiveness, hybridization success, and analysis thresholds and success.

The use of such methods to determine expression of malignant pleural mesothelioma nucleic acids from among SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 and/or proteins encoded by SEQ ID NOs:9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77 (e.g., SEQ ID NOs:10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78) can be done with routine methods known to those of ordinary skill in the art and the expression determined by protein measurement methods may be used as a prognostic method for selecting treatment strategies for malignant pleural mesothelioma patients.

EXAMPLES

Example 1

Diagnosis of Thoracic Malignancies Using Gene Expression Ratios

Introduction

Malignant pleural mesothelioma (MPM) is a highly lethal pleural malignancy (1). Patients with MPM frequently present with a malignant unilateral pleural effusion or pleural thickening. However, adenocarcinoma (ADCA) metastatic to the pleura of lung or other origin is a far more common etiology for patients presenting with a unilateral pleural effusion (1). The ultimate treatment strategies depend on the correct pathological diagnosis. Early MPM is best treated with extrapleural pneumonectomy followed by chemoradiation, whereas metastatic lung cancer is treated with chemotherapy alone (2). Not infrequently, distinguishing MPM from ADCA of the lung is challenging from both clinical and pathological perspectives (3). Fluid cytology is diagnostic in only 33% of the cases (2, 4) and sufficient additional tissue from an open surgical biopsy is often required for immunohistochemistry and cytogenetic analysis (1).

Current bioinformatics tools recently applied to microarray data have shown utility in predicting both cancer diagnosis (5) and outcome (6). Though highly accurate, their widespread clinical relevance and applicability are unresolved. The minimum number of predictor genes is not known, and the discrimination function can vary (for the same genes) based on the location and protocol used for sample preparation (5). Profiling with microarray requires relatively large quantities of RNA making the process inappropriate for certain applications. Also, it has yet to be determined if these approaches can utilize relatively low-cost and widely available data acquisition platforms such as RT-PCR and still retain significant predictive capabilities. Finally, the major limitation in translating microarray profiling to patient care is that this approach cannot currently be used to diagnose individual samples independently and without comparison to a predictor model generated from samples whose data was acquired on the same platform.

In this study we have explored an alternative approach using gene expression measurements to predict clinical parameters in cancer. Specifically, we have explored the feasibility of a simple, inexpensive test with widespread applicability that utilizes ratios of gene expression levels and rationally chosen thresholds to accurately distinguish between genetically disparate tissues. This approach circumvents many of the problems that prevent the penetration of expression profiling research into the clinical setting. We found that expression ratio-based diagnosis of MPM and lung cancer was similarly accurate compared to standard statistical methods of class discrimination such as linear discrimination analysis (7) and similar models (5) while addressing many of their deficiencies.

Materials and Methods

Tumor tissues. A combined total of 245 discarded MPM and lung ADCA surgical specimens were freshly collected (and snap frozen) from patients who underwent surgery at Brigham and Women's Hospital (BWH) between 1993 and 2001. Lung ADCA tumors consisted of both primary malignancies and metastatic ADCAs of breast and colon origin. All MPM samples used in these studies contained relatively pure tumor (greater than 50% tumor cells in a high power field examined in a section adjacent to the tissue used). Linked clinical and pathological data were obtained for all patients who contributed tumor specimens and rendered anonymous to protect patient confidentiality. Studies utilizing human tissues were approved by and conducted in accordance with the policies of the Institutional Review Board at BWH.

Microarray experiments. Total RNA (7 µg) was prepared from whole tumor blocks using Trizol Reagent (Invitrogen Life Technologies, Carlsbad, Calif.) and processed as described (8-10). cRNA was hybridized to human U95A oligonucleotide probe arrays (Affymetrix, Santa Clara, Calif.) using a protocol described previously (10). Data from 64 of 245 samples were discarded after visual inspection of hybridization data revealed obvious scanning artifacts, leaving a total of 31 MPM samples and 150 ADCA samples (139 patient tumors and 11 duplicates). Microarrays for all ADCA samples and 12 MPM samples were processed at the Dana-Farber Cancer Institute and the Whitehead Institute. The remaining 19 MPM samples were processed separately at BWH. Microarray data for the ADCA samples has been previously published (11). Bhattacharjee and colleagues used microarray data from ADCAs utilized in this study in combination with additional samples but not MPM, to identify distinct subclasses within ADCA of the lung and to search for prognostic markers. However, their study did not provide any comparison of gene expression between ADCA and MPM.

Real time quantitative RT-PCR. Total RNA (2 µg) was reverse-transcribed into cDNA using Taq-Man Reverse Transcription reagents (Applied Biosystems, Foster City, Calif.) and quantified using all recommended controls for SYBR Green-based detection. Primers amplifying portions of claudin-7, VAC-β, TACSTD1, and calretinin cDNA (synthesized by Invitrogen Life Technologies) had the following sequences (forward and reverse):

```
claudin-7

5'-GTTCCTGTCCTGGGAATGAG-3' (SEQ ID NO:87)
and
5'-AAGGAGATCCCAGGTCACAC-3' (SEQ ID NO:88);

VAC-β

5'-CCAGCCTTTCGGTCTTCTAT-3' (SEQ ID NO:89)
and
5'-CTGGAGGAAGTTGGGAAGAG-3' (SEQ ID NO:90);
```

-continued

TACSTD1

```
5'-AGCAGCTTGAAACTGGCTTT-3' (SEQ ID NO:91)
and
5'-AACGATGGAGTCCAAGTTCTG-3' (SEQ ID NO:92);
and
``` calretinin

```
5'-AGGACCTGGAGATTGTGCTC-3' (SEQ ID NO:93)
and
5-GAGTCTGGGTAGACGCATCA-3' (SEQ. ID NO:94).
```

Data analysis. Gene expression levels were appropriately scaled to facilitate comparison of data from arrays hybridized at different times and/or using multiple scanners. When the "average difference" was negative (i.e. negligible expression level), the absolute value was used. A two-tailed students t-test was used to compare the log(gene expression levels) for all 12,600 genes on the microarray between samples from a training set consisting of 16 MPM and 16 ADCA samples. All differences in the mean log(expression levels) between the samples in the two groups in the training set were determined to be statistically significant if $P<2\times10^{-6}$. Statistical comparisons (including linear discrimination analysis) were performed using S-PLUS (12). To generate the graphical representations of relative gene expression levels, all expression levels were first normalized within samples by setting the average (mean) to 0 and the standard deviation to 1. Scaled levels were assigned RGB values (representing 20 shades) for calorimetric display as a spectrum representing relative gene expression levels.

Results

Identification of Diagnostic Molecular Markers. We searched all of the genes represented on the microarray for those with a highly significant difference ($P<2\times10^{-6}$, $\geq$8-fold) in average expression levels between both tumor types in the training set of 16 ADCA and 16 MPM samples. For further analysis, we chose the 8 genes with the most statistically significant differences and a mean expression level >600 in at least one of the two training sample sets (gene name, GenBank Accession #): calretinin, X56667, ($P=8\times10^{-12}$), VAC-β, X16662, ($P=8\times10^{-13}$), TACSTD1, M93036, ($P=6\times10^{-12}$), claudin-7, AJ011497, ($P=2\times10^{-9}$), thyroid transcription factor-1 (TITF-1), U43203, ($P=10^{-9}$), MRC OX-2 antigen, X05323, ($P=5\times10^{-13}$), prostacyclin synthase (PTGIS), D83402, ($P=10^{-10}$), and hypothetical protein KIAA0977, AB023194, ($P=9\times10^{-11}$). Five of these genes were expressed at relatively higher levels in MPM tumors (calretinin, VAC-β, MRC OX-2, PTGIS, and KIAA0977) and 3 were expressed at relatively higher levels in ADCA tumors (TACSTD1, claudin-7, and TITF-1). We then investigated whether expression patterns of these genes extended to all samples (FIG. 1A).

Diagnostic Accuracy of Gene Expression Ratios. Using the 8 genes identified in the initial training set, we calculated 15 expression ratios per sample by dividing the expression value of each of the 5 genes expressed at relatively higher levels in MPM by the expression value of each of the 3 genes expressed at relatively higher levels in ADCA. Then, we tested the diagnostic accuracy of these ratios in the 149 remaining samples not included in the training set (i.e. 15 MPM and 134 ADCA). Samples with ratio values >1 were called MPM and those with ratio values <1 were called ADCA. We found that these ratios could be used to correctly distinguish between ADCA and MPM tumors with a high degree of accuracy (Table 1).

TABLE 1

Accuracy of all ratio combinations in predicting tumor diagnosis in test set

|  | Claudin-7 | TACSTD1 | TITF-1 |
|---|---|---|---|
| Calretinin | 97% (145/149) | 98% (146/149) | 91% (136/149) |
| VAC-β | 97% (144/149) | 97% (145/149) | 94% (140/149) |
| MRC OX-2 | 97% (145/149) | 97% (145/149) | 95% (142/149) |
| KIAA097 | 97% (145/149) | 95% (142/149) | 94% (140/149) |
| PTGIS | 97% (145/149) | 97% (144/149) | 96% (143/149) |

Eight candidate diagnostic genes were identified in a training set of samples as described in the Methods. A total of fifteen possible expression ratios (column/row intersection) were calculated where both genes used to form the ratio possessed inversely correlated expression levels in both tumor types. The accuracy of each ratio in predicting diagnosis was examined in the 149 remaining tumor specimens not included in the training set (15 mesothelioma and 134 adenocarcinoma). Predictions are stated as the fraction diagnosed correctly.

Figure 1B:
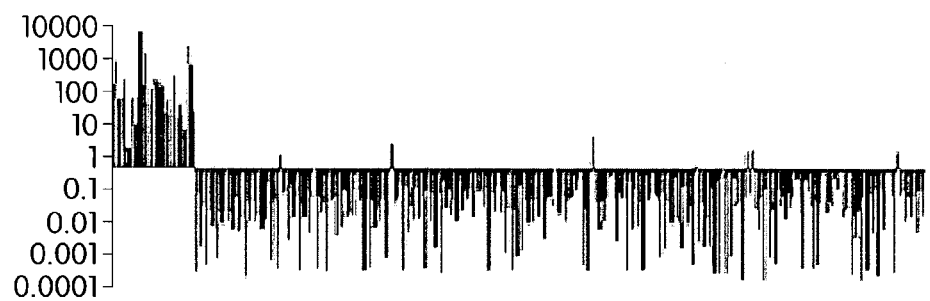
FIG. 1B, graphic depiction of the magnitude and direction, in all 149 samples comprising the test set, of the value for two independent ratios (calretinin/claudin-7 and VAC-β/TACSTD1) chosen for further study.
Figure 1C:
FIG. 1C, the 8 individual samples (represented by colored bars) that were misdiagnosed using one ratio or the other from FIG. 1B (blue bars for misdiagnosed MPM samples, red bars for misdiagnosed ADCA samples).

To incorporate data from multiple ratios, we then randomly chose a pair of independent ratios (calretinin/claudin-7 and VAC-β/TACSTD1) and examined their predictive accuracy in the test set. Each ratio (calretinin/claudin-7 and VAC-β/TACSTD1) was 97% (145/149) accurate with 4 errors (FIGS. 1B and 1C). Thus, a total of 8 samples were incorrectly diagnosed using either ratio. However, these two ratios were in disagreement for all 8 incorrectly diagnosed samples (FIG. 1C). When the diagnostic call of both ratios is combined, the final analysis results in 95% (141/149) of tumors correctly diagnosed with 0 errors and 8 no-calls. No-calls were conservatively made for samples when both ratios did not return the same diagnosis (FIG. 1C). To predict a diagnosis for the 8 no-calls, we randomly chose an additional ratio (MRC OX-2/TITF-1, Table 1). The addition of a third ratio established a majority diagnosis for the 8 samples that could not previously be determined using only two ratios. Using all 3 ratios (i.e. 6 genes), 99% (148/149) of tumors were correctly diagnosed; 7 no-calls were resolved and 1 sample was incorrectly diagnosed.

Comparison with Linear Discrimination Analysis. Standard statistical methods of class discrimination (7), such as linear discrimination analysis, can also be used to achieve similar results for these three pairs of genes. We first determined a linear combination of measured expression levels for each pair of genes that provided maximal discrimination between the two sets of tumor samples in the training set. When applied to the test set samples, the linear discrimination functions for the (calretinin, claudin-7), (VAC-β, TACSTD1), and (MRC OX-2, TITF-1) pairs each gave 6, 5, and 4 misclassifications, respectively. However, only one sample was incorrectly diagnosed in all three tests combined. In fact, the same errant sample was identified in the application of both the three ratio tests and the three linear discriminant tests. This sample was originally obtained from a patient with the clinical and pathological diagnosis of ADCA. This specimen was annotated by a pathologist reviewing frozen sections of all specimens prior to RNA preparation as having unusual histological features raising suspicion of a "germ cell tumor or sarcoma".

Figure 2:
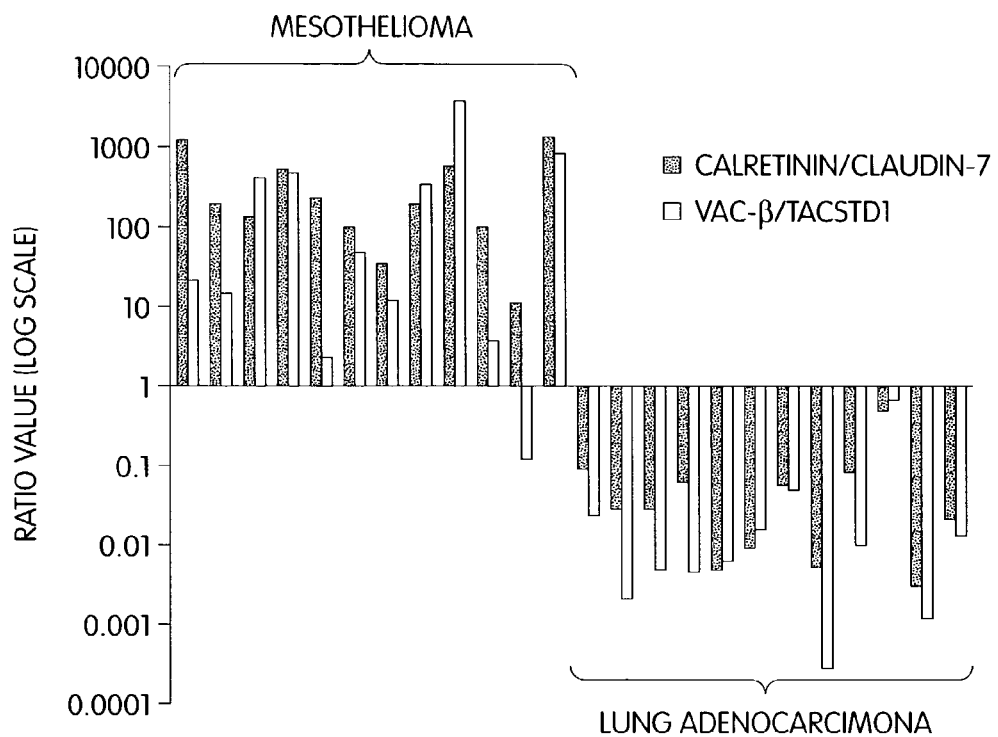
FIG. 2 depicts validation of microarray data and ratio based diagnosis. Quantitative RT-PCR was used to obtain ratio values for 12 MPM and 12 ADCA tumors. In this case, the two ratios correctly identified 23/24 samples with one no-call.

Verification of Microarray Data and Validation of Ratio-Based Diagnosis. We utilized real time quantitative RT-PCR (i) to confirm gene expression levels of diagnostic molecular markers identified in microarray-based analysis and (ii) to demonstrate that ratio-based diagnosis of MPM and lung cancer is equally accurate using data obtained from another platform. We randomly chose 12 tumor samples each of MPM and ADCA from those used in microarray analysis then calculated expression ratios for calretinin/claudin-7 and VAC-β/TACSTD1. Expression ratios correctly diagnosed 96% (23/24) of samples, with 0 errors and 1 no-call (FIG. 2).

Figure 3:
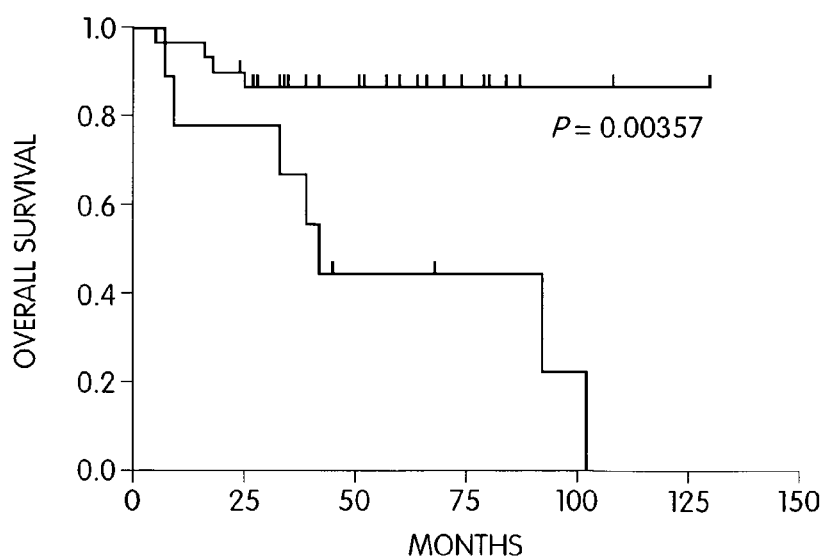
FIG. 3 shows Kaplan-Meier survival predictions for medulloblastoma patients. Overall survival for patients predicted to be treatment responders (top line) and treatment failures (bottom line) using a 6-gene (5-ratio) model in a test set of samples (n=40). Hash marks indicate censored data.

We have also explored the usefulness of expression ratios in predicting clinical parameters under more challenging circumstances, i.e. when predictor genes have substantially higher P values and smaller fold-change differences in average expression levels. In this analysis we used previously published microarray data (6) for a set of 60 medulloblastoma tumors with linked clinical data (Dataset "C") to create a ratio-based test designed to predict patient outcome after treatment. Of these 60 samples, 39 and 21 originated from patients classified as "treatment responders" and "treatment failures", respectively. We used a training set composed of 20 randomly chosen samples (10 responders and 10 failures) to identify predictor genes. A total of 10 genes fit our filtering criteria (P<0.05, >2-fold change in average expression levels, at least one mean >200) and we chose the most significant three genes expressed at relatively higher levels in each group for further analysis (gene name, GenBank Accession #): histone 2A, M37583, (P=0.012), GTPase rho C, L25081, (P=0.026), protein gene product 9.5, X04741, (P=0.046), neurofilament-66, S78296, (P=0.0025), sulfonylurea receptor, U63455, (P=0.0067), cell surface protein HCAR, U90716, (P=0.030). Using the previously stated diagnostic criteria, we calculated a total of 9 possible expression ratios using data from these 6 genes and examined their predictive accuracy in the remaining samples (i.e., the test set, n=29 responders and n=11 failures). A total of 5 ratios were equally accurate (75%, 30/40) in predicting test set samples and, in combination, utilized all 6 predictor genes. Our accuracy rate in a true test set of samples is similar to that reported by Pomeroy and colleagues (78%, 47/60) using all 60 samples to develop an 8-gene k-nearest neighbor predictor model (6). To incorporate the predictive accuracy of multiple ratios (and genes), we calculated the geometric mean of these 5 ratios to give equal weight to ratios with identical magnitude but opposite direction. Finally, we performed Kaplan-Meier survival analysis using predictions made from the geometric mean value. We found that a 6-gene (5-ratio) model could significantly (P=0.00357, log-rank test) predict patient outcome after treatment in the test set of samples (FIG. 3). This P value is moderately lower than that reported by Pomeroy et al. (P=0.009) using all 60 samples to assess their 8-gene k-nearest neighbor predictor model (6). There was no overlap in the list of genes comprising our model and that of these investigators, suggesting that multiple genes are present in this malignancy that have similar predictive capability.

Discussion

Accurate diagnosis of cancer (or any disease) is the first critical step in choosing appropriate treatments that will hopefully result in the best possible outcome. We propose that the ratio-based method described herein that utilizes expression levels of carefully chosen genes can be a simple, inexpensive, and highly accurate means to distinguish MPM from ADCA of the lung and that this method is applicable to many other clinical scenarios. We have also shown that multiple highly accurate ratios can be combined to form a simple diagnostic tool using the ratio direction ("majority rules" approach, e.g., MPM and lung cancer diagnosis) or the ratio magnitude (calculation of the geometric mean, e.g., prediction of outcome in medulloblastoma). The gene expression ratio method, by virtue of the fact that it is a ratio (i) negates the need for a third reference gene when determining expression levels, (ii) is independent of platform used for data acquisition, (iii) requires only small quantities of RNA (as little as 10 pg using RT-PCR), (iv) does not require the coupling of transcription to translation for chosen genes, and (v) permits analysis of individual samples without reference to additional "training samples" whose data was acquired on the same platform. For these reasons, expression ratios are more likely to find immediate use in clinical settings since they confer several advantages compared to other equally accurate techniques, such as linear discriminant analysis.

The small P values and large fold-differences in average expression levels between genes used in expression ratio-based diagnosis of MPM and lung cancer are not surprising given that both tumor types have different cell types of origin. It is important to note that we have not determined in the current study the exact magnitude and consistency by which gene expression needs to differ between any two groups to allow the usage of a simple ratio test. In other clinical scenarios the differences in gene expression patterns between groups to be distinguished may be more subtle, thus necessitating a relaxed filtering criteria in choosing potential predictor genes. Even in these cases, simple ratios can still be a highly accurate means of predicting clinical parameters. We have also found that expression ratios are useful in predicting outcome after therapy in MPM using genes with considerably higher P values and lower fold-differences in average expression levels than those used in the current study (Gordon et al., manuscript submitted). In the current study, we have used previously published microarray data (6) to identify a small number of predictor genes that were able to significantly predict outcome after therapy in medulloblastoma in a true test set of samples using simple expression ratios. Nevertheless, in some cases larger numbers of genes (and perhaps sophisticated software) and/or initial expression profiling of a larger number of specimens for the training set may be required to achieve acceptable predictive power.

The selection of diagnostic genes for MPM and lung cancer was based solely on our stated criteria. Nevertheless, many of the molecular markers with the lowest P values and greatest difference in average expression levels have notable cancer relevance and/or are known to have tissue specific expression patterns. Calretinin (13, 14) and TITF-1 (15, 16) are part of several immunohistochemical panels currently used in the diagnosis of MPM and lung cancer. Claudin family members are expressed in various cancers (17, 18) and TACSDT1 (alias TROP1) is a recently described marker for carcinoma cells and, as a cell surface receptor protein, has been postulated to play a role in growth regulation of tumor cells (19, 20). The discovery of diagnostic gene ratios is likely to make possible future clinical tests to definitively diagnose MPM and ADCA using smaller tissue specimens and perhaps pleural effusions. In this way the need for diagnostic surgery in many of these patients may be eliminated.

The expression ratio technique represents a substantial improvement over past efforts to translate the strengths of expression profiling into simple tests with clinical relevancy. Many bioinformatics tools under development and testing are quite complex and/or rely upon data from large numbers of "training samples" to establish a diagnosis for unknown samples. The end result is that the practical use of microarray data remains beyond the scope of many scientists and clinicians. Similarly, no comprehensive method has been proposed to translate the results of tumor profiling to the analysis of individual tissues. As a consequence, no simple yet effective clinical applications have resulted from microarray research. The expression ratio technique represents a powerful use of microarray data that can be easily adapted and extended to routine clinical application without the need for additional sophisticated analysis.

References for Example 1

1. Aisner, J. Diagnosis, staging, and natural history of pleural mesothelioma. In: J. Aisner, R. Arriagada, M. R. Green, N. Martini, and M. C. Perry (eds.), Comprehensive Textbook of Thoracic Oncology, pp. 799-785. Baltimore: Williams and Wilkins, 1996.
2. Pass, H. Malignant pleural mesothelioma: Surgical roles and novel therapies, Clin Lung Cancer. 3: 102-117, 2001.
3. Ordonez, N. G. The immunohistochemical diagnosis of epithelial mesothelioma, Hum Pathol. 30: 313-323, 1999.
4. Nguyen, G.-K., Akin, M.-R. M., Villanueva, R. R., and Slatnik, J. Cytopathology of malignant mesothelioma of the pleura in fine-needle aspiration biopsy, Diagn Cytopathol. 21: 253-259, 1999.
5. Golub, T. R., Slonim, D. K., Tamayo, P., Huard, C., Gaasenbeek, M., Mesirov, J. P., Coller, H., Loh, M. L., Downing, J. R., Caligiuri, M. A., Bloomfield, C. D., and Landers, E. S. Molecular classification of cancer: class discovery and class prediction by gene expression monitoring, Science. 286: 531-537, 1999.
6. Pomeroy, S. L., Tamayo, P., Gaasenbeek, M., Sturla, L. M., Angelo, M., McLaughlin, M. E., Kim, J. Y. H., Goumnerova, L. C., Black, P. M., Lau, C., Allen, J. C., Zagzag, D., Olson, J. M., Curran, T., Wetmore, C., Biegel, J. A., Poggio, T., Mukherjee, S., Rifkin, R., Califano, A., Stolovitzky, G., Louis, D. N., Mesirov, J. P., Lander, E. S., and Golub, T. R. Prediction of central nervous system embryonal tumor outcome based on gene expression, Nature. 415: 436-442, 2002.
7. Dudoit, S., Fridlyand, J., and Speed, T. P. Comparison of discrimination methods for the classification of tumors using gene expression data, J Am Stat Assoc. In Press:, 2002.
8. Wang, K., Gan, L., Jeffery, E., Gayle, M., Gown, A. M., Skelly, M., Nelson, P. S., Ng, W. V., Schummer, M., Hood, L., and Mulligan, J. Monitoring gene expression profile changes in ovarian carcinomas using cDNA microarrays, Gene. 229: 101-108, 1999.
9. Warrington, J. A., Nair, A., Hahadevappa, M., and Tsyganskaya, M. Comparison of human adult and fetal expression and identification of 535 housekeeping/maintenance genes, Physiol Genomics. 2: 143-147, 2000.
10. O'Dell, S. D., Bujac, S. R., Miller, G. J., and Day, I. N. Associations of IGF2 ApaI RFLP and INS VNTR class I allele size with obesity, Eur J Hum Genet. 7: 565-576, 1999.
11. Bhattacharjee, A., Richards, W. G., Staunton, J., Li, C., Monti, S., Vasa, P., Ladd, C., Beheshti, J., Bueno, R., Gillette, M., Loda, M., Weber, G., Mark, E. J., Lander, E. S., Wong, W., Johnson, B. E., Golub, T. R., Sugarbaker, D. J., and Meyerson, M. Classification of human lung carcinomas by mRNA expression profiling reveals distinct adenocarcinoma sub-classes, Proc Natl Acad Sci USA. 98: 13790-13795, 2001.
12. Venables, W. N. and Riley, B. D. Modem Applied Statistics with S-Plus. New York: Springer, 1997.
13. Lozano, M. D., Panizo, A., Toledo, G. R., Sola, J. J., and Pardo-Mindan, J. Immunocytochemistry in the differential diagnosis of serous effusions: a comparative evaluation of eight monoclonal antibodies in Papanicolaou stained smears, Cancer. 93: 68-72, 2001.
14. Sato, S., Okamoto, S., Ito, K., Konno, R., and Yajima, A. Differential diagnosis of mesothelial and ovarian cancer cells in ascites by immunocytochemistry using Ber-EP4 and calretinin, Acta Cytol. 44: 485-488, 2000.
15. Di Loreto, C., Puglisi, F., Di Lauro, V., Damante, G., and Beltrami, C. A. TTF-1 protein expression in malignant pleural mesotheliomas and adenocarcinomas of the lung, Cancer Lett. 124: 73-78, 1998.
16. Ordonez, N. G. The value of antibodies 44-36A, SM3, HBME-1, and thrombomodulin in differentiating epithelial pleural mesothelioma from lung adenocarcinoma, Am J Surg Pathol. 21: 1399-1408, 1997.
17. Michl, P., Buchholz, M., Rolke, M., Kunsch, S., Lohr, M., McClane, B., Tsukita, S., Leder, G., Adler, G., and Gress, T. M. Claudin-4: a new target for pancreatic cancer treatment using Clostridium perfringens enterotoxin, Gastroenterology. 121: 678-684, 2001.
18. Hough, C. D., Sherman-Baust, C. A., Pizer, E. S., Montz, F. J., Im, D. D., Rosenshein, N. B., Cho, K. R., Riggins, G. J., and Morin, P. J. Large-scale serial analysis of gene expression reveals genes differentially expressed in ovarian cancer, Cancer. 60: 6281-6287, 2000.
19. Alberti, S., Nutini, M., and Herzenberg, L. A. DNA methylation prevents the amplification of TROP1, a tumor-associated cell surface antigen gene, Proc Natl Acad Sci USA. 91: 5833-5837, 1994.
20. Calabrese, G., Crescenzi, C., Morizio, E., Palka, G., Guerra, E., and Alberti, S. Assignment of TACSTD1 (alias TROP1, M4S1) to human chromosome 2p21 and the refinement of mapping of TACSTD2 (alias TROP2, M1S1) to human chromosome 1p32 by in situ hybridization, Cytogenet Cell Genet. 92: 164-165, 2001.

Example 2

Molecular Markers for Malignant Pleural Mesothelioma

Introduction

In this study we have refined a gene expression measurements approach to predict clinical parameters in cancer, including distinguishing between subclasses of malignant pleural mesothelioma and distinguishing between malignant pleural mesothelioma and lung adenocarcinoma. We have found that ratios of gene expression levels can accurately distinguish between genetically disparate tissues.

Methods

MPM tissues. Discarded malignant pleural mesothelioma (MPM) surgical specimens were freshly collected from patients undergoing pleurectomy or extrapleural pneumonectomy at Brigham and Women's Hospital (Boston, Mass.) from 1992 to 1998 and flash frozen. All tissues were obtained from patients who did not receive pre-operative treatment. Standard tissue banking procedures were followed throughout. Once brought to the Hospital Tumor Bank, tissues were sliced into 3 mm$^3$ portions and assigned an identifier to catalogue its position in the original specimen. Hematoxylin-stained slides were generated from each MPM specimen in the Tumor Bank and reviewed by a pathologist for tumor content and histological subtype. A total of 80 specimens have been identified to date that contain relatively pure tumor (greater than 50% of cells in a high power field are tumor cells). Of these, 24 were chosen for microarray analysis. Linked clinical, epidemiological, outcome, and pathological data were obtained for all patients who contributed tumor specimens and rendered anonymous to protect patient confidentiality. Studies utilizing human tissues were approved by and conducted in accordance with the policies of the Institutional Review Board at Brigham and Women's Hospital.

Tissue processing and RNA preparation. Total RNA was isolated from frozen tumor blocks using Trizol solution (Invitrogen Life Technologies, Carlsbad, Calif.) exactly per the manufacturer's recommended protocol. To initially assess total RNA degradation, a portion of RNA from each sample was resolved on a 1% agarose/formadehyde gel using standard procedures (Ausubel, 1998). Gels were stained with ethidium bromide and bands representing ribosomal subunits 28S and 18S were visualized. Approximately 10% of samples collected were discarded secondary to unsatisfactory quality.

Total RNA (7 µg) was amplified and the product labeled with biotin following a procedure previously described (Wang, 1999; Warrington, 2000; O'Dell, 1999). Briefly, double-stranded cDNA was synthesized using the SuperScript Choice System (Invitrogen Life Technologies) and a T7-(dT)-24 first strand primer (Geneset Oligos, La Jolla, Calif.). The cDNA was purified by phenol/chloroform/isoamyl alcohol extraction using a phase lock gel (5 Prime-3 Prime, Inc., Boulder, Colo.) and concentrated by ethanol precipitation. In vitro transcription was performed to produce biotin-labeled cRNA using a BioArray HighYield RNA Transcript Labeling Kit (Affymetrix, Santa Clara, Calif.) according to the manufacturer's instructions. Linearly amplified cRNA was obtained by incubation with T7 RNA polymerase. Final cRNA preparations were cleaned with RNeasy Mini kit (Qiagen, Valencia, Calif.).

Hybridization of RNA to high density oligonucleotide microarrays. Prior to hybridization to experimental arrays, the quality of cRNA was assessed for approximately half of all samples using test arrays (Affymetrix Test2 gene arrays) designed to compare relative expression levels of β-actin and GAPDH by using oligonucleotide probes complementary to both the 3' and 5' ends of gene products. Hybridization of test arrays was done as detailed below for experimental arrays with minor modifications as suggested by the manufacturer (Affymetrix). Biotinylated cRNA (20 µg) was fragmented and hybridized to microarrays containing oligonucleotide probe-sets representing approximately 12,000 known human genes (Affymetrix U95A human array, HG-95Av2) according to Affymetrix protocols using a protocol described previously (O'Dell, 1999). Essentially, the hybridization mixture was incubated at 99° C. for 5 min. followed by incubation at 45° C. for 5 min. before injection of the sample into the probe array cartridge. Hybridization was performed at 45° C. for 16-18 hours. After washing, the array was stained with streptavidin-phycoerythrin (Molecular Probes, Eugene, Oreg.) and the hybridization signal amplified using a biotinylated anti-streptavidin antibody (Vector Laboratories, Inc., Burlingame, Calif.) before subsequent scanning in a HP GeneArray scanner (Affymetrix).

The intensity of all features of microarrays were captured and examined for artifacts using Affymetrix GeneChip® Software v. 4.0, according to standard Affymetrix procedures (O'Dell, 1999). The "target intensity" was set to 100 for all samples. Each array contained several prokaryotic genes which served as internal hybridization controls for RNA spiked into experimental samples. Data from 5 arrays was uninterpretable and discarded, leaving a total of 19 samples in the final analysis. Of these 19, 2 were tested in duplicate and 1 in triplicate. GeneChip® Software was used to generate quantitative gene expression values (measured by average differences).

Real time quantitative RT-PCR. Gene expression data obtained from microarrays was verified using real time quantitative RT-PCR. PCR reactions were set up, optimized, and performed precisely following the manufacturer's recommended protocol (Sequence Detection System, Applied Biosystems, Foster City, Calif.). Total RNA (2 µg) was reverse-transcribed into cDNA using Taq-Man Reverse Transcription reagents and random hexamers as the primer (Applied Biosystems). PCR reactions were set up in a 25 µl reaction volume using SYBR Green PCR Master Mix (Applied Biosystems). Optimized primers amplifying portions of fibronectin, transgelin, complement factor B (CFB), and L32 ribosomal protein cDNA were designed according to recommended specifications (Applied Biosystems), synthesized by Invitrogen Life Technologies, and used at a final concentration of 900 nM in the reaction mixture.

Primer sequences were as follows:

| | | |
|---|---|---|
| fibronectin | 5'-GCCATGACAATGGTGTGAAC-3' and | (SEQ ID NO:1) |
| | 5'-GCAAATGGCACCGAGATATT-3'; | (SEQ ID NO:2) |
| transgelin | 5'-AGGACTCTGGGGTCATCAAG-3' and | (SEQ ID NO:3) |
| | 5'-AGTTGGGATCTCCACGGTAG-3'; | (SEQ ID NO:4) |
| CFB | 5'-TGAGGCTTCCTCCAACTACC-3' and | (SEQ ID NO:5) |
| | 5'-TGCCTTTCTTATCCCCATTC-3'; | (SEQ ID NO:6) |
| L32 | 5'-AACCCAGAGGCATTGACAAC-3' and | (SEQ ID NO:7) |
| | 5'-ACTTCCAGCTCCTTGACGTT-3'. | (SEQ ID NO:8) |

PCR amplification was performed in a 96-well format using optical plates and covers (Applied Biosystems) in an Applied Biosystems 5700 Sequence Detector. To confirm the absence of non-specific amplification in PCR reactions, no-template controls containing $H_2O$ substituted for template were run in multiple wells on every reaction plate. In addition, a melting point disassociation curve was automatically generated after every experiment to confirm the presence of a single PCR species in all experimental wells. The Comparative $C_T$ method was used to obtain quantitative values for gene expression levels in all samples (Applied Biosystems, see www.appliedbiosystems.com for details). This method normalizes expression levels between samples using another (housekeeping) gene as a reference to standardize for different starting template amounts.

Briefly, amplification reactions are characterized by the point in time during cycling when amplification of a PCR product is first detected rather than by the amount of PCR product accumulated after a fixed number of cycles. In the initial cycles of PCR, there is little change in fluorescence signal, which defines the baseline for the amplification plot. An increase in fluorescence above the baseline indicates the detection of accumulated PCR product. A fixed fluorescence threshold can be set above the baseline. The parameter CT (threshold cycle) is defined as the fractional cycle number at which the fluorescence passes the fixed threshold. The higher the starting copy number of the nucleic acid target, the sooner an increase in fluorescence past the selected threshold is observed. A plot of the log of initial target copy number for a set of standards versus CT is a straight line. Therefore, quantification of the amount of target in unknown samples is accomplished by measuring CT and using the standard curve to determine starting copy number. The L32 ribosomal gene was used for this purpose since its expression levels did not vary substantially over all samples (from microarray data).

Data analysis. A hierarchical clustering algorithm (AGNES) in the statistical package S-PLUS (Venables, 1997) was used to classify all 19 MPM tumors according to relative variation in gene expression patterns. All linked clinical data was held exclusively by one investigator and revealed only after cluster analysis was completed. Gene hybridization intensities (from GeneChip® Software) were appropriately scaled to a "target intensity" of 100 to facilitate comparison of data from all arrays. To minimize contamination from signal background and saturation effects (Hsiao, 2001), only genes with an expression value between 1,000 and 5,000 were considered in the unsupervised cluster analysis.

The significance of observed differences in gene expression levels between selected MPM subclasses was assessed using a Kruskal-Wallis test (nonparametric ANOVA) followed by Dunn's Multiple Comparison test. A Mann-Whitney test was used for selective pairwise comparisons, such as median patient survival. The degree of correlation between patient survival and matched gene expression levels was examined using Spearman correlation calculations and trendlines were obtained by generating a LOWESS curve. Contingency tables were analyzed using a chi-square test for independence and a chi-square test for trend. All differences were determined to be statistically significant if $P<0.05$. Calculations and statistical comparisons were generated using GraphPad Prism v.3.02 (GraphPad Software, San Diego, Calif.). To generate the graphical representations of relative gene expression levels (log 2 scale), all expression levels were first normalized within samples by setting the average (mean) to 0 and the standard deviation to 1. Scaled levels were assigned RGB values (representing 17 shades) for colorimetric display as a spectrum representing relative gene expression levels.

Results

Identification of MPM subclasses using hierarchical cluster analysis. Variation in the patterns of gene expression levels in 19 MPM tumors were examined using unsupervised cluster analysis, and distinct classes were identified based on similar expression profiles. The dendrogram specifying the grouping of samples shows that MPM tumors segregate into 2 major subclasses. A major division in the distribution of samples separates 6 tumor specimens from all others (designated Subclass 1). The remaining 13 samples form 2 distinct subclasses that cluster tightly on opposite sub-branches (designated Subclasses 2 and 3). A maximum of 145 genes with relatively high expression levels between 1,000 and 5,000 (i.e, average difference) was sufficient to accurately define MPM subclasses. Only a portion of the 145 genes used for analysis are identified here. The complete set is available in Table 6.

A set of 26 genes was identified as providing a redundant set of diagnostic gene expression ratios that can be used in different combinations (Table 2). There is some overlap to ensure complete coverage of samples to correct for "no-calls" for any one ratio.

TABLE 2

| Gene elevated in | Accession # | Symbol | Name | SEQ ID NOs:* |
|---|---|---|---|---|
| Meso/Adeno | | | | |
| adeno | J02761 | SFTBP | surfactant pulmonary associated protein B | 9, 10 |
| adeno | M93036 | TACSTD1 | tumor associated calcium signal transducer 1 | 11, 12 |
| adeno | AJ011497 | CLDN7 | claudin 7 | 13, 14 |
| meso | X56667 | CALB2 | calbindin 2 (calretinin) | 15, 16 |
| meso | X16662 | ANXA8 | annexin 8 | 17, 18 |
| meso | M21389 | KRT5 | keratin 5 | 19, 20 |
| Meso/Normal | | | | |
| meso | X03168 | VTN | vitronectin | 21, 22 |
| meso | X76029 | NMU | neuromedin U | 23, 24 |
| meso | X56667 | CALB2 | calbindin 2 (calretinin) | 15, 16 |
| normal | U43203 | TITF1 | thyroid transcription factor 1 | 25, 26 |
| normal | M18728 | CEACAM6 | carcinoembryonic Ag-related cell adhesion molecule 6 | 27, 28 |
| normal | T92248 | UGB | uteroglobin | 29, 30 |
| Meso/Squamous | | | | |
| meso | AI651806 | LOC51232 | cysteine-rich repeat containing protein S52 precursor | 31, 32 |
| meso | X56667 | CALB2 | calbindin 2 (calretinin) | 15, 16 |
| meso | D83402 | PTGIS | prostacyclin synthase | 33, 34 |
| squa | U42408 | LAD1 | ladinin 1 | 35, 36 |
| squa | L33930 | CD24 | CD24 antigen | 37, 38 |
| squa | AI539439 | S100A2 | S100 calcium-binding protein A2 | 39, 40 |

TABLE 2-continued

| Gene elevated in | Accession # | Symbol | Name | SEQ ID NOs:* |
|---|---|---|---|---|
| Ept/All Other | | | | |
| ept | AL049963 | LOC64116 | up-regulated by BCG-CWS | 41, 42 |
| ept | L15702 | CFB | complement factor B (CFB) | 43, 44 |
| other | M95787 | TAGLN | transgelin | 45, 46 |
| Subclass 1/2 (also see ept/other) | | | | |
| 1 | AL049963 | LOC64116 | up-regulated by BCG-CWS | 41, 42 |
| 2 | NM_001953 | ECGF1 | endothelial cell growth factor 1 | 47, 48 |
| Subclass 1/3 | | | | |
| 1 | M22919 | MYL6 | myosin, light polypeptide 6 | 49, 50 |
| 3 | X06256 | ITGA5 | integrin, alpha 5 | 51, 52 |
| Subclass 2/3 | | | | |
| 2 | Z98946 | MSN | moesin | 53, 54 |
| 2 | AI540958 | PIN | dynein | 55, 56 |
| 3 | AI677689 | KIAA0685 | KIAA0685 gene product | 57, 58 |
| 3 | M31932 | FCGR2A | Fc fragment of IgG, low affinity IIa | 59, 60 | meso = malignant pleural mesothelioma
adeno = adenocarcinoma
normal = normal lung tissue
squa = squamous carcinoma
ept = epithelial
*SEQ ID NOs are given as nucleotide sequence, amino acid sequence Genes that serve multiple purposes (and are listed more than one) are italicized. There are a total of 26 genes.

The functional distribution of these reliably expressed genes can be roughly classified as follows: 33% ribosomal, 7% cytoskeletal, 6% inflammatory/immune, 3% extracellular matrix (ECM), 3% intracellular signaling, 2% proliferation, and 46% other, multiple, or unknown function. Approximately two-thirds of the 145 genes were expressed at substantially higher levels in samples from Subclass 1; the remaining one-third were expressed at relatively higher levels in samples from Subclasses 2 and 3. Ribosomal proteins account for approximately 50% of all genes overexpressed in Subclass 1. Genes overexpressed in Subclasses 2 and/or 3 consisted predominately of cytoskeletal and ECM-related genes such as actin, vimentin, tubulin, myosin, cofilin, osteonectin, and others. The organization of MPM subclasses was extremely robust and reproducible. For example, samples assigned to Subclasses 1, 2, and 3 remain in the same subclass when cluster analysis is repeated incorporating data from 3 samples chosen at random for duplicate (n=2) and triplicate (n=1) hybridization experiments on different microarrays.

Clinical characteristics of MPM subclasses. Linked clinical data for individual samples are presented in tabular format and arranged according to subclass membership (Table 3). Samples in Subclass 1 and 2 consisted exclusively of specimens histologically classified as epithelial and mixed subtypes, respectively. Subclass 3 consisted of members of all major histological subtypes: epithelial (n=3), mixed (n=4), and sarcomatoid (n=2). Two samples were excluded from survival analysis since they originated from patients whose status was either unknown (sample 116, Subclass 1) or who did not die from disease (sample 118, Subclass 2). The analysis of cancer related clinical outcome (using nonparametric ANOVA) revealed that the median survival (19 months) of patients in Subclass 1 (all epithelial subtype) was significantly higher ($P<0.01$) than the median survival (2 months) of patients in Subclass 2 (all mixed subtype). The median survival of patients with varied histology in Subclass 3 (11 months) was intermediate to Subclasses 1 and 2, but nonetheless was not significantly different ($P>0.05$) from that of either Subclass. There was no significant difference in survival between patients with epithelial histology classified as either Subclass 1 or 3. However, patients with mixed histology classified as Subclass 2 samples (all "short-lived" mixed) had significantly shorter ($P=0.029$) median survival (2 months) when compared to the median survival (11.5 months) of patients with mixed histology classified as Subclass 3 (all "long-lived" mixed). Although asbestos count and exposure history appeared to be lower in members of Subclass 1, there are insufficient data at this time to draw meaningful conclusions. Beyond patient survival, there were no other significant associations between samples in MPM subclasses and any other aspect of the clinical data.

TABLE 3

| Sample # | Age | Sex | Histology[a] | Smoking Hx | Pack Years[b] | Asbestos Exposure Hx | Asbestos Fiber Count[c] | Survival[d] | Status |
|---|---|---|---|---|---|---|---|---|---|
| Group 1 | | | | | | | | | |
| 76 | 67 | m | ept. | yes | 13 | neg. | — | 17 | 3 |
| 86 | 42 | f | ept. | no | 0 | neg. | 0 | 9 | 3 |
| 116 | 70 | m | ept. | yes | — | neg. | 50 | 9 | U |
| 90 | 48 | m | ept. | no | 0 | pos. | — | 28 | 2 |
| 68 | 61 | m | ept. | yes | 30 | neg. | 168 | 21 | 3 |
| 109 | 62 | m | ept. | yes | 14 | pos. | — | 19 | 3 |
| Group 2 | | | | | | | | | |
| 89 | 55 | m | mixed | yes | 4.5 | pos. | 147 | 3 | 3 |
| 118 | 74 | m | mixed | yes | 73.8 | pos. | 119 | 7 | 4 |
| 133 | 69 | m | mixed | no | 0 | pos. | 17,547 | 2 | 3 |
| 114 | 51 | m | mixed | yes | 3.75 | neg. | 2919 | 2 | 3 |
| Group 3 | | | | | | | | | |
| 101 | 71 | f | ept. | yes | 15 | pos. | — | 11 | 3 |
| 93 | 52 | m | ept. | yes | 113 | pos. | — | 15 | 3 |
| 229 | 33 | f | ept. | no | 0 | pos. | 13 | 5 | 3 |
| 105 | 66 | m | mixed | yes | 38 | pos. | 290 | 12 | 3 |
| 72 | 46 | m | mixed | yes | 25 | pos. | 6540 | 53 | 3 |
| 213 | 55 | m | mixed | yes | 5 | pos. | 266 | 11 | 1 |
| 130 | 55 | m | mixed | yes | 10 | pos. | 69 | 6 | 3 |
| 159 | 62 | m | sarc. | no | 0 | pos. | — | 2 | 3 |
| 166 | 66 | m | sarc. | yes | 30 | pos. | 451 | 6 | 3 |

—data unavailable
[a] ept. epithelial; sarc., sarcomatoid
[b] packs per day×years smoking
[c] per gram of lung tissue; control median value ~70
[d] in months
[e] 1, alive without disease; 2, alive with disease; 3, dead with disease; 4, dead other causes; U, unknown Identification of prognostic and diagnostic molecular markers for MPM. To identify candidate prognostic molecular markers for MPM, all 12,000 genes on the microarray were searched to find those with expression levels that were significantly different between tumors of Subclass 1 (best prognosis) and Subclass 2 (worst prognosis). Not surprisingly, many of these genes also distinguished samples of epithelial histology from tumors of all other subtypes, and for this reason may further serve as diagnostic molecular markers. Approximately 400 genes on the microarray fit our selection criteria (average expression level >1000 in at least one group) and the most statistically significant ($P10^{-3}–10^{-6}$) 11 genes are listed in Table 4.

TABLE 4

| Accession # | Name | SEQ ID NOs:* |
|---|---|---|
| M95787 | SM22 (transgelin) | 45, 46 |
| Z82215 | DNA sequence from PAC 68O2 | 61, 62 |
| X13839 | vascular smooth muscle alpha-actin | 63, 64 |
| L19182 | MAC25 | 65, 66 |
| J04599 | proteoglycan I (biglycan) | 67, 68 |
| X02761 | fibronectin | 69, 70 |
| X15882 | collagen VI | 71, 72 |
| Y14690 | procollagen alpha 2(V) | 73, 74 |
| L15702 | complement factor B (CFB) | 43, 44 |
| N47307 | cDNA, 3 end/clone = IMAGE-280506 | 75, 76 |
| L38941 | ribosomal protein L34 (RPL34) | 77, 78 |

*SEQ ID NOs are given as nucleotide sequence, amino acid sequence

The fact that these genes also distinguish samples of the epithelial subtype suggests that tumors of the same histological subtype possess certain similarities in gene expression despite being assigned to different classes using hierarchical clustering. Another set of genes that distinguishes between subclass 1 and subclass 2 is presented in Table 7. Of the 11 genes in Table 4, the first 8 are expressed at relatively lower levels and the final three genes are expressed at higher levels in epithelial subtype samples (subclass 1) compared to all others.

From this set, two genes with relatively low levels of expression in epithelial subtype samples (transgelin and fibronectin, $P=10^{-4}$ and 0.0028 respectively) and one with relatively high levels of expression in epithelial subtype samples (complement factor B (CFB), $P=10^{-4}$) were chosen. Expression levels for all three genes were significantly ($P<0.05$) correlated with survival irrespective of histological subtype. Furthermore, expression level ratios of transgelin/CFB and fibronectin/CFB were also significantly correlated with survival independent of histology. Levels of transgelin and fibronectin were approximately equal in individual samples; accordingly, the fibronectin/transgelin ratio remains close to 1 for all samples and is not correlated with survival.

When individual patient ratios of either transgelin/CFB or fibronectin/CFB were 10 or greater, survival was lowest (median survival=2 months, range 2-6 months). Conversely, when these ratios are 1 or less, patient survival was substantially higher (median survival=13 months, range 5-28 months). Additionally, 80% (8/10) of patients whose ratio is less than 1 survived at least 9 months.

Another set of genes was identified to distinguish between adenocarcinoma and malignant pleural mesothelioma in accordance with the procedures described above. These genes are presented in Table 8.

Figure 4A:
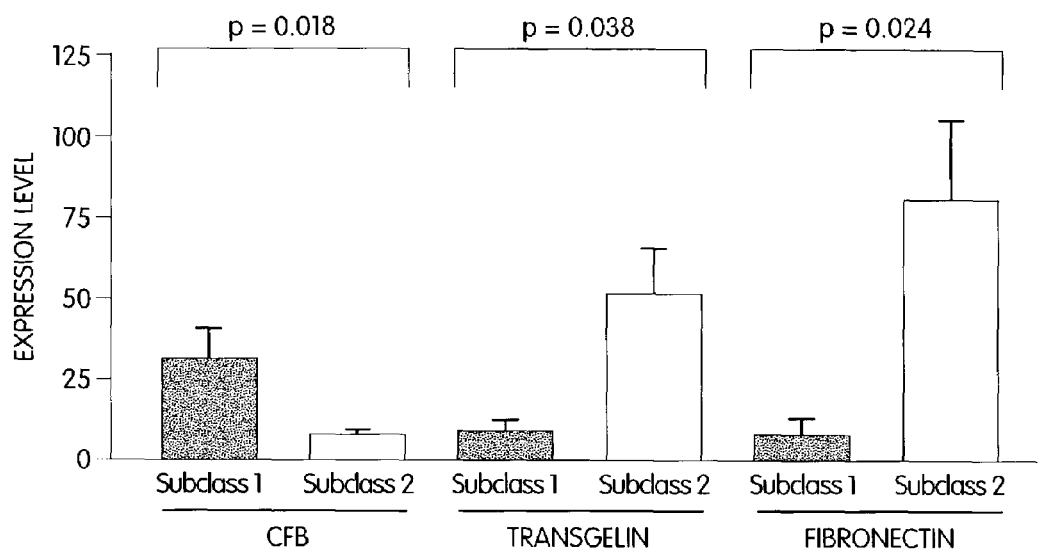
FIG. 4A shows that the average expression levels of CFB, transgelin, and fibronectin are significantly (P<0.05) different in tumor samples from Subclass 1 and Subclass 2.

Validation of microarray-based analysis of gene expression. Quantitative RT-PCR was utilized to verify gene expression levels of the molecular markers identified in microarray-based analysis. As expected, average expression levels for CFB were significantly higher, ($P=0.019$) and average expression levels for transgelin and fibronectin significantly lower (P=0.038, and P=0.024, respectively) in samples from Subclass 1 (good prognosis) compared to Subclass 2 (poor prognosis) (FIG. 4A).

Figure 4B:
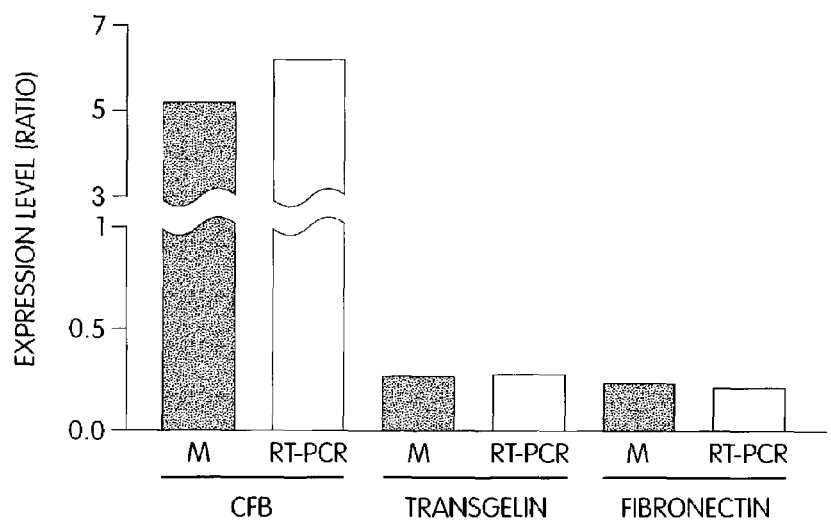
FIG. 4B shows that the expression level ratios remain consistent in distinguishing epithelial tumor samples from all others using data obtained from either microarray analysis or RT-PCR. Ratio represents the average gene expression level in epithelial subtype tumors relative to the average expression level of all other tumors combined. Error bars, SEM; M, data from microarray analysis; RT-PCR, data from quantitative RT-PCR analysis.
Figure 5A:
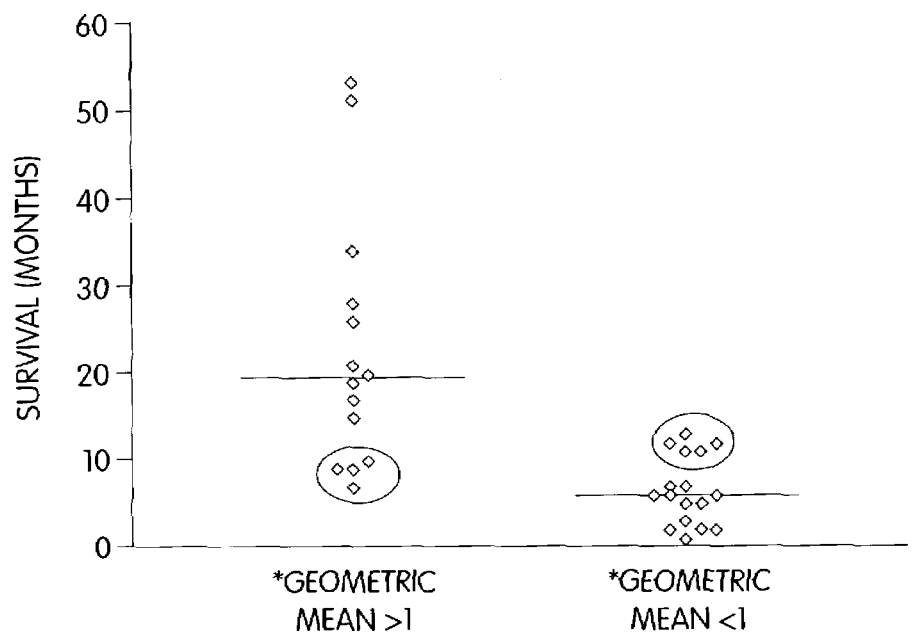
FIG. 5A, survival of 31 MPM patients whose outcome was predicted using a 4-gene expression ratio model.
Figure 5B:
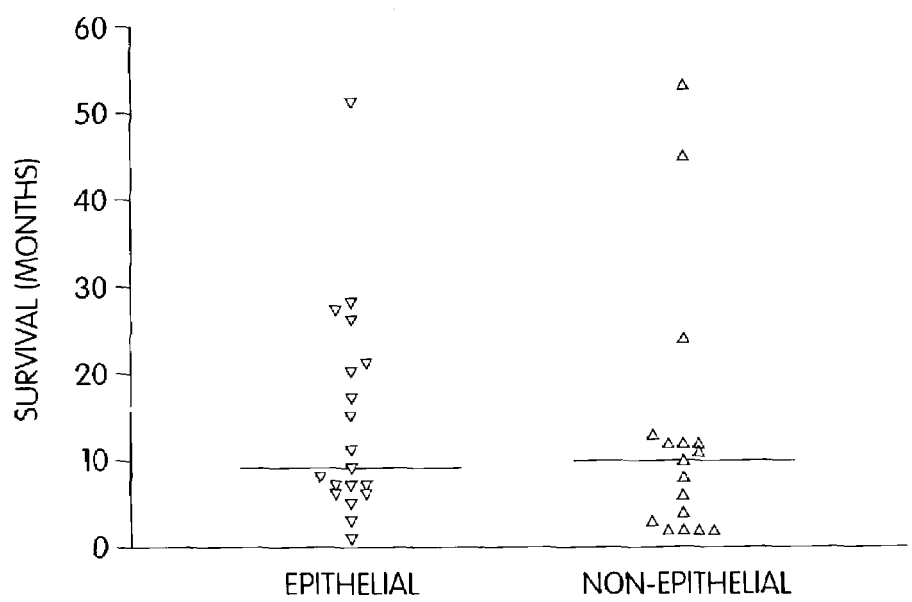
FIG. 5B, survival of the 31 MPM patient samples from FIG. 5A plus 5 additional samples (36 total) as a function of tumor histological subtype. Prediction of outcome using the geometric mean value of 3 expression ratios is more accurate than the use of histological appearance alone at identifying patients with widely divergent outcome (FIG. 5A). Although patients with epithelial histology tumors tend to survive longer, predicting prognosis in this manner is highly inexact for any individual patient (FIG. 5B). Each data point represents a single sample. Circles enclose tumor samples from patients with survival at or near the median for MPM. Horizontal bars depict median survival for each group. *, geometric mean calculated from the 3 most accurate expression ratios used to predict outcome (using data from a total of 4 genes).

We then determined whether expression ratios created using microarray data could be accurately reproduced using quantitative RT-PCR data. Ratios were created by expressing individual gene levels in epithelial subtype samples relative to levels in all other subtypes combined (FIG. 4B). We found that ratios created using data from both platforms were in relative agreement for all 3 genes. Expression level ratios (and individual expression levels) obtained from RT-PCR were also significantly correlated with survival for transgelin/CFB (P=0.0015) and fibronectin/CFB (P=0.009) independent of the histological subtype.

Verification of Expression Level Ratios as Prognostic and Diagnostic Molecular Markers.

To verify the prognostic capability of gene expression ratios, quantitative RT-PCR was used to obtain expression level values for transgelin and CFB in 17 additional tumor samples not subjected to microarray analysis. (Two of these samples were omitted because they did not express detectable levels of one or both genes.) Based on the prior analysis of samples using microarrays, we hypothesized for the remaining 15 samples that patients with transgelin/CFB ratios above 1 (n=6) would have generally poor prognosis, and those with ratios below 1 (n=9) would have generally good prognosis. In this case, ratios correctly identified the 3 individuals with the best clinical outcome (20-, 21-, and 51-month survival) and the 3 individuals with the worst clinical outcome (2-, 2-, and 4-month survival).

To increase the sample size for statistical considerations, RT-PCR data from these patients was combined with that from patients whose tumors were subjected to microarray analysis, for a total of 32 samples. In this larger sample set, patient survival was significantly (P=0.0011) correlated with matched values for transgelin/CFB expression ratios. As expected, median patient survival is inversely proportional to the value of the transgelin/CFB expression ratio.

Next, we formed a contingency table by sorting the number of patient samples with transgelin/CFB expression ratios either above 1 or below 1 into groups representing 5-month survival increments (Table 5). In this case, the prognostic value of the transgelin/CFB expression ratio was again confirmed. Statistical analysis revealed that survival and ratio value were significantly associated (P=0.007) and that this association follows a significant linear trend (P=0.0076). Still, prediction of prognosis was most efficient at either survival extreme (<5 months and >15 months) with 100% of samples from patients with poor survival having ratios >1 and nearly 85% of patients with the longest survival having ratios <1 (Table 5).

TABLE 5

| T/C Ratio[a] | Median Patient Survival[b] |
|---|---|
| Greater than 10 | 4 (n = 8) |
| Greater than 1 | 5 (n = 14) |
| Less than 1 | 12 (n = 18) |

TABLE 5-continued

| Less than 0.5 | 14 (n = 12) |
|---|---|
| Less than 0.1 | 17 (n = 4) |
| All samples | 9 (n = 32) |

| Survival[b] | Samples with T/C ratio <1 | Samples with T/C ratio >1 |
|---|---|---|
| <5 | 0/7 (0%) | 7/7 (100%) |
| 5-10 | 8/11 (73%) | 3/11 (27%) |
| 10-15 | 5/8 (63%) | 3/8 (37%) |
| >15 | 5/6 (83%) | 1/6 (17%) |

[a]Value of transgelin/CFB gene expression level ratio
[b]in months

As mentioned previously, prognostic markers were originally selected by examining gene expression level differences between samples in subclasses with the greatest difference in median patient survival (Subclass 1 and Subclass 2, see Table 3). It also was found that these genes could distinguish tumors of the epithelial subtype from all others. Then, using the larger cohort of samples, we examined whether there was evidence that the transgelin/CFB expression ratio provided a valuable diagnostic tool in addition to a predictor of prognosis. We found that the transgelin/CFB expression ratio identified the histological subtypes of tumors with a high degree of accuracy. All epithelial subtype tumors (16/16, 100%) had ratio values <1 and nearly all mixed/sarcomatoid subtype tumors (14/16, 88%) had ratio values >1. The 2 non-epithelial subtype samples that were incorrectly diagnosed in this case originated from patients with a typically long survival (12 and 13 months), much longer than the median survival (6 months) of all non-epithelial subtype samples, thereby reflecting the original intent of the ratio (i.e. prediction of prognosis).

Following the use of appropriate filtering techniques (e.g., Hsiao, 2001), expression level ratios were found to be extremely robust in differentiating the epithelial subtype of MPM using raw data obtained from Affymetrix arrays with probe sets representing 6,800 genes (n=11) and from Affymetrix arrays with probe sets representing 12,000 genes hybridized and scanned by another laboratory (n=13). In these 24 samples, the transgelin/CFB ratio correctly predicted histological subtype in 18 with 2 errors and 4 marginal calls. (The marginal calls were conservatively made when the ratio value was between 0.5 and 2.)

The genes used to create expression ratios (e.g., transgelin and CFB) are not random predictors of diagnosis/prognosis, but have notable biological relevance to carcinogenesis. CFB is significantly overexpressed in epithelial tumors while transgelin is significantly underexpressed in the same samples. Transgelin binds to native actin filament bundles and gels actin in vitro (Shapland, 1993) and has been proposed as a marker of neoplastic transformation (Lawson, 1997). CFB has been implicated in tumor apoptosis in a manner independent of TNF/TNFR or FasL/Fas interactions (Uwai, 2000). Although not determined in this study to have a functional role in MPM carcinogenesis, CFB's pro-apoptotic function is consistent with the observations showing high levels of this gene significantly correlated with relatively good prognosis (i.e. survival).

TABLE 6

| Accession No.: Description |
|---|
| M81757:*H. sapiens* S19 ribosomal protein mRNA, complete cds |
| U14969:Human ribosomal protein L28 mRNA, complete cds |

TABLE 6-continued

| Accession No.: Description |
|---|

M62895:Human lipocortin (LIP) 2 pseudogene mRNA, complete cds-like region
AL022097:*Homo sapiens* DNA sequence from PAC 256G22 on chromosome 6p24.1-25.3.
Z28407:*H. sapiens* mRNA for ribosomal protein L8
X64707:*H. sapiens* BBC1 mRNA
U14971:Human ribosomal protein S9 mRNA, complete cds
X17206:Human mRNA for LLRep3
M17885:Human acidic ribosomal phosphoprotein P0 mRNA, complete cds
AL031228:dJ1033B10.4 (40S ribosomal protein S18 (RPS18, KE-3
L11566:*Homo sapiens* ribosomal protein L18 (RPL18) mRNA, complete cds
M17733 :Human thymosin beta-4 mRNA, complete cds
U14972:Human ribosomal protein S10 mRNA, complete cds
M64716:Human ribosomal protein S25 mRNA, complete cds
X67247:*H. sapiens* rpS8 gene for ribosomal protein S8
X16064:Human mRNA for translationally controlled tumor protein
J04755:Human ferritin H processed pseudogene, complete cds
L05095:*Homo sapiens* ribosomal protein L30 mRNA, complete cds
AL022326:dJ333H23.1.1 (60S Ribosomal Protein L3)
Z48501:*H. sapiens* mRNA for polyadenylate binding protein II
X69391:*H. sapiens* mRNA for ribosomal protein L6
X65923:*H. sapiens* fau mRNA
M17886:Human acidic ribosomal phosphoprotein P1 mRNA, complete cds/
M17886:Human acidic ribosomal phosphoprotein P1 mRNA, complete cds
L06499:*Homo sapiens* ribosomal protein L37a (RPL37A) mRNA, complete cds
X55954:Human mRNA for HL23 ribosomal protein homologue
M13934:Human ribosomal protein S14 gene, complete cds
X63527:*H. sapiens* mRNA for ribosomal protein L19
U14968:Human ribosomal protein L27a mRNA, complete cds
U14970:Human ribosomal protein S5 mRNA, complete cds
L06498:*Homo sapiens* ribosomal protein S20 (RPS20) mRNA, complete cds
X53777:Human L23 mRNA for putative ribosomal protein
Z12962:*H. sapiens* mRNA for homologue to yeast ribosomal protein L41
AB002533:*Homo sapiens* mRNA for Qip1, complete cds
X80822:*H. sapiens* mRNA for ORF
L01124:Human ribosomal protein S13 (RPS13) mRNA, complete cds
D23661:Human mRNA for ribosomal protein L37, complete cds
L38941:*Homo sapiens* ribosomal protein L34 (RPL34) mRNA, complete cds
X95404:*H. sapiens* mRNA for non-muscle type cofilin
U14966:Human ribosomal protein L5 mRNA, complete cds
X52851:Human cyclophilin gene for cyclophilin (EC 5.2.1.8)
AF037643:*Homo sapiens* 60S ribosomal protein L12 (RPL12) pseudogene, partial sequence
Z49148:*H. sapiens* mRNA for ribosomal protein L29
X15940:Human mRNA for ribosomal protein L31
M94314:*Homo sapiens* ribosomal protein L30 mRNA, complete cds
Z26876:*H. sapiens* gene for ribosomal protein L38
Z19554:*H. sapiens* vimentin gene
X04098:Human mRNA for cytoskeletal gamma-actin
M13932:Human ribosomal protein S17 mRNA, complete cds
M13932:Human ribosomal protein S17 mRNA, complete cds
M24194:Human MHC protein homologous to chicken B complex protein mRNA, complete cds
M24194:Human MHC protein homologous to chicken B complex protein mRNA, complete cds
M58458:Human ribosomal protein S4 (RPS4X) isoform mRNA, complete cds
AB021288:*Homo sapiens* mRNA for beta 2-microglobulin, complete cds
X55715:Human Hums3 mRNA for 40S ribosomal protein s3
AL031670:dJ681N20.2 (ferritin, light polypeptide-like 1)
X56932:*H. sapiens* mRNA for 23 kD highly basic protein
X67309:*H. sapiens* gene for ribosomal protein S6
X57958:*H. sapiens* mRNA for ribosomal protein L7
U09953:Human ribosomal protein L9 mRNA, complete cds
K00558:human alpha-tubulin mRNA, complete cds
X03342:Human mRNA for ribosomal protein L32
M31520:Human ribosomal protein S24 mRNA
X63432:*H. sapiens* ACTB mRNA for mutant beta-actin (beta-actin)
X06617:Human mRNA for ribosomal protein S11
AB009010:*Homo sapiens* mRNA for polyubiquitin UbC, complete cds
AB009010:*Homo sapiens* mRNA for polyubiquitin UbC, complete cds
U37230:Human ribosomal protein L23a mRNA, complete cds
M26252:Human TCB gene encoding cytosolic thyroid hormone-binding protein, complete cds
D23660:Human mRNA for ribosomal protein, complete cds
L20941:Human ferritin heavy chain mRNA, complete cds
M16660:Human 90-kDa heat-shock protein gene, cDNA complete cds
M22919:Human nonmuscle/smooth muscle alkali myosin light chain gene, complete cds
U34995:Human normal keratinocyte substraction library mRNA, clone H22a, complete sequence
Z23090:*H. sapiens* mRNA for 28 kDa heat shock protein
J03077:Human co-beta glucosidase (proactivator) mRNA, complete cds
X56009:Human GSA mRNA for alpha subunit of GsGTP binding protein
X04409:Human mRNA for coupling protein G(s) alpha-subunit (alpha-S1)
M14630:Human prothymosin alpha mRNA, complete cds TABLE 6-continued

| Accession No.: Description |
|---|
| AB011114:*Homo sapiens* mRNA for KIAA0542 protein, complete cds |
| AI201310:qf71b11.x1 *Homo sapiens* cDNA, 3 end |
| AI525834:PT1.3_06_D01.r *Homo sapiens* cDNA, 5 end |
| AF054187:*Homo sapiens* alpha NAC mRNA, complete cds |
| AF054187:*Homo sapiens* alpha NAC mRNA, complete cds |
| J04182:*Homo sapiens* lysosomal membrane glycoprotein-1 (LAMP1) mRNA, complete cds |
| R87876:yo45h01.r1 *Homo sapiens* cDNA, 5 end |
| J03592:Human ADP/ATP translocase mRNA, 3 end |
| T89651:yd99a05.s1 *Homo sapiens* cDNA, 3 end |
| X79234:*H. sapiens* mRNA for ribosomal protein L11 |
| X13546:Human HMG-17 gene for non-histone chromosomal protein HMG-17 |
| D32129:Human mRNA for HLA class-I (HLA-A26) heavy chain, complete cds (clone cMIY-1) |
| X57352:Human 1-8U gene from interferon-inducible gene family |
| U73824:Human p97 mRNA, complete cds |
| U49869:Human ubiquitin gene, complete cds |
| AI526078:DU3.2-7.G08.r *Homo sapiens* cDNA, 5 end |
| AI557852:P6test.G05.r *Homo sapiens* cDNA, 5 end |
| X58965:*H. sapiens* RNA for nm23-H2 gene |
| X74929:*H. sapiens* KRT8 mRNA for keratin 8 |
| W52024:zd13a03.s1 *Homo sapiens* cDNA, 3 end |
| AI050224:*Homo sapiens* mRNA; cDNA DKFZp586L2123 (from clone DKFZp586L2123) |
| A1541542:libtest16.A02.r *Homo sapiens* cDNA, 5 end |
| M33680:Human 26-kDa cell surface protein TAPA-1 mRNA, complete cds |
| M63573:Human secreted cyclophilin-like protein (SCYLP) mRNA, complete cds |
| Z11692:*H. sapiens* mRNA for elongation factor 2 |
| M22806:Human prolyl 4-hydroxylase beta-subunit and disulfide isomerase (P4HB) gene |
| X62654:*H. sapiens* gene for Me491/CD63 antigen |
| X13710:*H. sapiens* unspliced mRNA for glutathione peroxidase |
| J00194:human hla-dr antigen alpha-chain mrna & ivs fragments |
| X58536:Human mRNA for HLA class I locus C heavy chain |
| U15131:Human p126 (ST5) mRNA, complete cds |
| L13210:Human Mac-2 binding protein mRNA, complete cds |
| AI541256:pec1.2-3.F11.r *Homo sapiens* cDNA, 5 end |
| J04599:Human hPGI mRNA encoding bone small proteoglycan I (biglycan), complete cds |
| AA044823:zk72a10.s1 *Homo sapiens* cDNA, 3 end/clone = IMAGE-488346 |
| J02984:Human insulinoma rig-analog mRNA encoding DNA-binding protein, complete cds |
| AF095154:*Homo sapiens* C1q-related factor mRNA, complete cds |
| L41498:*Homo sapiens* longation factor 1-alpha 1 (PT1-1) mRNA, complete cds |
| X56681:Human junD mRNA |
| M94046:Human zinc finger protein (MAZ) mRNA |
| AA977163:oq25a04.s1 *Homo sapiens* cDNA, 3 end |
| AA977163:oq25a04.s1 *Homo sapiens* cDNA, 3 end |
| M55914 = HUMCMYCQ Human c-myc binding protein (MBP-1) mRNA, complete cds |
| M64241 = HUMQM Human Wilm s tumor-related protein (QM) mRNA, complete cds |
| X58965 = HSNM23H2G *H. sapiens* RNA for nm23-H2 gene |
| D11139 = HUMTIMP Human gene for tissue inhibitor of metalloproteinases, partial sequence |
| M55409 = HUMPANCAN *Homo sapiens* pancreatic tumor-related protein mRNA, partial cds |
| M84711 = HUMFTE1A Human v-fos transformation effector protein (Fte-1), mRNA complete cds |
| X56681 = HSJUNDR Human junD mRNA |
| M26880 = HUMUBI13 Human ubiquitin mRNA, complete cds |
| X04803 = HSYUBG1 *Homo sapiens* ubiquitin gene |
| D78361 = HUMODAZ Human mRNA for ornithine decarboxylase antizyme, ORF 1 and ORF 2 |
| J04617 = HUMEF1A Human elongation factor EF-1-alpha gene, complete cds |
| J04988 = HUMHSP90B Human 90 kD heat shock protein gene, complete cds |
| D00017 = HUMLIC *Homo sapiens* mRNA for lipocortin II, complete cds |
| J03040 = HUMSPARC Human SPARC/osteonectin mRNA, complete cds |
| J04164 = HUM927A Human interferon-inducible protein 9-27 mRNA, complete cds |
| V00567 = HSMGLO Human messenger RNA fragment for the beta-2 microglobulin |
| D14530 = HUMRSPT HUMan homolog of yeast ribosomal protein S28, complete cds |
| Ribosomal Protein S20 |
| M14199 = HUMLAMR Human laminin receptor (2H5 epitope) mRNA, 5 end |
| M63138 = HUMCATD5 Human cathepsin D (catD) gene, exons 7, 8, and 9 |
| S82297 = S82297 beta 2-microglobulin |
| V00599 = HSTUB2 Human mRNA fragment encoding beta-tubulin. (from clone D-beta-1) |

TABLE 7

| Symbol | Description |
|---|---|
| BF | B-factor, properdin |
| MSLN | mesothelin |
| TM4SF1 | transmembrane 4 superfamily member 1 |
| CYC1 | cytochrome c-1 |
| RPL12 | ribosomal protein L12 |
| POLR2L | polymerase (RNA) II (DNA directed) polypeptide L (7.6 kD) |
| RPL18 | ribosomal protein L18 |

TABLE 7-continued

| Symbol | Description |
| --- | --- |
| RPL18A | ribosomal protein L18a |
| RPS23 | ribosomal protein S23 |
| RPS21 | ribosomal protein S21 |
| RPL27 | ribosomal protein L27 |
| K-ALPHA-1 | tubulin, alpha, ubiquitous |
| ARHGAP1 | Rho GTPase activating protein 1 |
| TPM1 | tropomyosin 1 (alpha) |
| APOL | apolipoprotein L |
| TPM1 | tropomyosin 1 (alpha) |
| SPARC | secreted protein, acidic, cysteine-rich (osteonectin) |
| COL1A2 | collagen, type I, alpha 2 |
| FN1 | fibronectin 1 |
| NA | Fibronectin, Alt. Splice 1 |
| FN1 | fibronectin 1 |
| COL5A2 | collagen, type V, alpha 2 |
| COL1A2 | collagen, type I, alpha 2 |
| ACTA2 | actin, alpha2, smooth muscle, aorta |
| TAGLN | transgelin |

TABLE 8

| Accession # | Symbol | Description |
| --- | --- | --- |
| U38980 | PMS2L11 | postmeiotic segregation increased 2-like 11 |
| J04152 | TACSTD2 | tumor-associated calcium signal transducer 2 |
| AI820718 | | *Homo sapiens* cDNA, 5 end |
| U43203 | TITF1 | thyroid transcription factor 1 |
| AB000714 | CLDN3 | claudin 3 |
| AJ002308 | SYNGR2 | synaptogyrin 2 |
| AB000712 | CLDN4 | claudin 4 |
| AF015128 | | *Homo sapiens* IgG heavy chain variable region (Vh26) mRNA |
| M18728 | CEACAM6 | carcinoembryonic antigen-related cell adhesion molecule 6 |
| D83402 | | *Homo sapiens* gene for prostacyclin synthase |
| J02761 | SFTPB | surfactant, pulmonary-associated protein B |
| X56667 | CALB2 | calbindin 2, (29kD, calretinin) |
| X16662 | ANXA8 | annexin (A8 vascular anticoagulant-beta (VAC-beta)) |
| AB016789 | GFPT2 | glutamine-fructose-6-phosphate transaminase 2 |
| Z93930 | XBP1 | X-box binding protein 1 |
| AI651806 | LOC51232 | cysteine-rich repeat-containing protein S52 precursor, |
| AW024285 | | *Homo sapiens* cDNA, 3 end |
| AI445461 | TM4SF1 | transmembrane 4 superfamily member 1 |
| M93036 | TACSTD1 | tumor-associated calcium signal transducer 1 |
| M21389 | KRT5 | keratin 5 |

References for Example 2

1. Golub, T. R. et al. Molecular classification of cancer: class discovery and class prediction by gene expression monitoring. Science 286, 531-537 (1999).
2. Perou, C. M. et al. Molecular portraits of human breast tumours. Nature 406, 747-752 (2000).
3. Hedenfalk, I. et al. Gene expression profiles in hereditary breast cancer. N Engl J Med 344, 539-548 (2001).
4. Khan, J. et al. Classification and diagnostic prediction of cancers using gene expression profiling and artificial neural networks. Nat Med 7, 673-679 (2001).
5. Quackenbush, J. Computational analysis of microarray data. Nat Rev Genet 2, 418-427 (2001).
6. Corson, J. M. & Renshaw, A. A. Pathology of mesothelioma. in Comprehensive Textbook of Thoracic Oncology (eds Aisner, J., Arriagada, R., Green, M.R., Martini, N. & Perry, M. C.) 757-758 (Williams and Wilkins, Baltimore, Md., 1996).
7. Virtaneva, K. et al. Expression profiling reveals fundamental biological differences in acute myleoid leukemia with isolated trisomy 8 and normal cytogenetics. Proc Natl Acad Sci USA 98, 1124-1129 (2001).
8. Welsh, J. B. et al. Analysis of gene expression profiles in normal and neoplastic ovarian tissue samples identifies candidate molecular markers of epithelial ovarian cancer. Proc Natl Acad Sci USA 98, 1176-1181 (2001).
9. Clark, E. A., Golub, T. R., Lander, E. S. & Hynes, R. O. Genomic analysis of metastasis reveals an essential role for RhoC. Nature 406, 532-535 (2000).
10. Mountain, C. F. Revisions in the international system for staging lung cancer. Chest 111, 1710-1717(1997).
11. Fodor, S. A. Massively parallel genomics. Science 277, 393-395 (1997).
12. Lawson, D., Harrison, M. & Shapland, C. Fibroblast transgelin and smooth muscle SM22a are the same protein, the expression of which is down-regulated in many cell lines. Cell Motil Cytoskeleton 38, 250-257 (1997).
13. Shapland, C., Hsuan, J. J., Totty, N. F. & Lawson, D. Purification and properties of transgelin: A transformation and shape change sensitive actin-gelling protein. J Cell Biol 121, 1065-1073 (1993).
14. Uwai, M. et al. A new apoptotic pathway for the complement factor B-derived fragment Bb. J Cell Physiol 185, 280-292 (2000).
15. Sugarbaker, D. J. et al. Extrapleural pneumonectomy in the multimodality therapy of malignant pleural mesothelioma. Results in 120 consecutive patients. Ann Surg 224, 288-294 (1996).
16. Wang, K. et al. Monitoring gene expression profile changes in ovarian carcinomas using cDNA microarrays. Gene 229, 101-108 (1999).
17. Warrington, J. A., Nair, A., Hahadevappa, M. & Tsyganskaya, M. Comparison of human adult and fetal expression and identification of 535 housekeeping/maintenance genes. Physiol Genomics 2, 143-147 (2000).
18. O'Dell, S. D., Bujac, S. R., Miller, G. J. & Day, I. N. Associations of IGF2 ApaI RFLP and INS VNTR class I allele size with obesity. Eur J Hum Genet 7, 565-576 (1999).
19. Venables, W. N. & Riley, B. D. Modern Applied Statistics with S-Plus, (Springer, N.Y., 1997).
20. Harrison's Principles of Internal Medicine, 14/e, (McGraw-Hill Companies, N.Y., 1998).
21. The Chipping Forecast, Nature Genetics, 21(1), 1-60 (1999).
22. Gwynne, P., and Page, G., Microarray Analysis: the next revolution in Molecular Biology, Science eMarketplace, Science, Aug. 6 (1999). (sciencemag.org/feature/e-market/benchtop/micro.shl)
23. Molecular Cloning: A Laboratory Manual, J. Sambrook, et al., eds., Second Edition, (Cold Spring Harbor Laboratory Press, Cold Spring Harbor, N.Y., 1989).
24. Current Protocols in Molecular Biology, F. M. Ausubel, et al., eds., (John Wiley & Sons, Inc., New York, 1999).
25. Wagner et al., Nature Biotechnol. 14, 840-844 (1996).
26. Sainio, K., Saarma, M., Nonclercq, D., Paulin, L., and Sariola, H. Antisense inhibition of low-affinity nerve growth factor receptor in kidney cultures: power and pitfalls. Cell Mol. Neurobiol. 14(5), 439-457 (1994).

Example 3

Prediction of Outcome in Mesothelioma Using Gene Expression Ratios

Introduction

Malignant pleural mesothelioma is an asbestos related, lethal neoplastic disease of the pleura (median survival between 4 and 12 months) subdivided into three major histological subtypes: epithelial, mixed, and sarcomatoid (1-4). Compared to patients with non-epithelial subtypes, patients with the epithelial subtype show a survival benefit from a variety of treatment strategies, including aggressive multimodality therapy (5-7). Currently, patients who present to our unit with unilateral mesothelioma without extrapleural invasion undergo complete surgical resection (extra-pleural pneumonectomy) followed by chemoradiation. The 5-year survival for those patients with stage I and epithelial histology is 40%. However, there are no predictive factors, prognostic molecular markers, or genetic abnormalities other than histological subtype to preoperatively identify these (or other) long-term survivors. In addition, established methods to predict outcome in mesothelioma based on histological appearance are somewhat subjective, prone to human error, and are ineffective for small patient cohorts or in extreme cases for individual patients (3,8,9).

Gene expression profiling using microarrays holds promise to improve strategies for tumor classification as well as for prediction of response to therapy and survival in cancer (10-16). Nevertheless, no clear consensus exists regarding which computational tools are optimal for the analysis of large gene expression profiling data sets, particularly when predicting outcome. As a result, microarray-based research has not yet significantly impacted the clinical treatment of disease. Recently, we have shown that simple ratios of gene expression using as few as four to six genes are highly accurate in the diagnosis of cancer and we hypothesized that this technique was equally useful in additional clinical applications (17). To explore this further, we used gene expression profiling data (17) of mesothelioma samples from patients with widely divergent survival to create an expression ratio-based test capable of predicting outcome in mesothelioma in a manner independent of the histological subtype of the tumor. We found that a simple test (based on the expression levels of four genes) can (i) predict outcome in mesothelioma with high accuracy, (ii) use relatively inexpensive data acquisition platforms, and (iii) analyze individual patients without reference to additional samples.

Methods

Mesothelioma tumor tissues. Discarded mesothelioma surgical specimens were freshly collected and flash frozen from patients undergoing definitive surgery for mesothelioma at Brigham and Women's Hospital who did not receive preoperative treatment (6). To train an outcome predictor model in this study, we used previously published microarray data (17) to identify a subset of mesothelioma samples obtained from patients with widely divergent survival (n=17 total). An additional 29 samples (i.e., the test set) were used for quantitative RT-PCR analysis only. Each tumor specimen contained greater than 50% tumor cells. Linked clinical and pathological data were obtained for all patients who contributed tumor specimens and rendered anonymous to protect patient confidentiality. Studies utilizing human tissues were approved by and conducted in accordance with the policies of the Institutional Review Board at Brigham and Women's Hospital.

Real time quantitative RT-PCR. Total RNA (2 µg) isolated from 29 tumors in the test set was reverse-transcribed into cDNA using Taq-Man Reverse Transcription reagents (Applied Biosystems, Foster City, Calif.) and quantified using all recommended controls. Primer sequences (synthesized by Invitrogen Life Technologies) were as follows (forward and reverse):

| | | |
|---|---|---|
| L6 | 5'-TTCCATTCCACAATGTGCTT-3' and | (SEQ ID NO:79) |
| | 5'-GGCCAGTGGAACTACACCTT-3'; | (SEQ ID NO:80) |
| KIAA0977 | 5'-AACCGAAGCCTAACCTGAGA-3' and | (SEQ ID NO:81) |
| | 5'-GTCATTTTGGGAGCAGGTTT-3'; | (SEQ ID NO:82) |
| GDIA1 | 5'-AGAAGCAGTCGTTTGTGCTG-3' and | (SEQ ID NO:83) |
| | 5'-TGTACTTCATGCCGGACACT-3'; | (SEQ ID NO:84) |
| CTHBP | 5'-ATCTGAAGTTTGGGGTCGAG-3' and | (SEQ ID NO:85) |
| | 5'-TCTCTCCCAGGACCTTCCTA-3'. | (SEQ ID NO:86) |

PCR amplification was performed using an Applied Biosystems 5700 Sequence Detector. No-template (negative) controls containing $H_2O$ substituted for template were run in multiple wells on every reaction plate. An automatically calculated melting point disassociation curve generated after every assay was examined to ensure the presence of a single PCR species and a lack of primer-dimer formation in each well. The Comparative $C_T$ method (Applied Biosystems) was used with minor modifications to obtain quantitative values for gene expression ratios in all samples. Calculation of an expression ratio using data from two genes in any single sample negates the need for a calibrator sample and a reference gene to standardize for different starting template amounts. Therefore, to form expression ratios of two genes, we merely stated the expression level of one gene relative to the other. In this case, the $\Delta\Delta C_T$ value in the Comparative $C_T$ equation reduces to: $[C_{T(gene\ 1)} - C_{T(gene\ 2)}]$.

Data and statistical analysis. A two-sided Student's (parametric) t-test was used for pair-wise comparisons of average gene expression levels among multiple groups and the Significance Analysis of Microarrays (SAM) algorithm (18) was used to estimate the false discovery rate. Kaplan-Meier curves were used to estimate survival in each group. The log-rank test was used to statistically assess differences among multiple survival curves. A Cox proportional-hazards regression model was used for multivariate analysis. The "leave-one-out" method of cross validation (16,19,20) was used to assess internal consistency of the predictor model and analyzed using Fisher's exact test (i.e. 2×2 contingency table). All differences were determined to be statistically significant if P<0.05. Data from three highly accurate gene expression ratios were combined by calculating the geometric mean, $(R_1 R_2 R_3)^{1/3}$, where $R_i$ represents a single ratio value. This is the mathematical equivalent to the average of $[\log_2(R_1), \log_2(R_2), \log_2(R_3)]$, thereby giving equal weight to ratio fold-changes of identical magnitude but opposite direction. All calculations and statistical comparisons were generated using S-PLUS (21).

Results

Figure 6A:
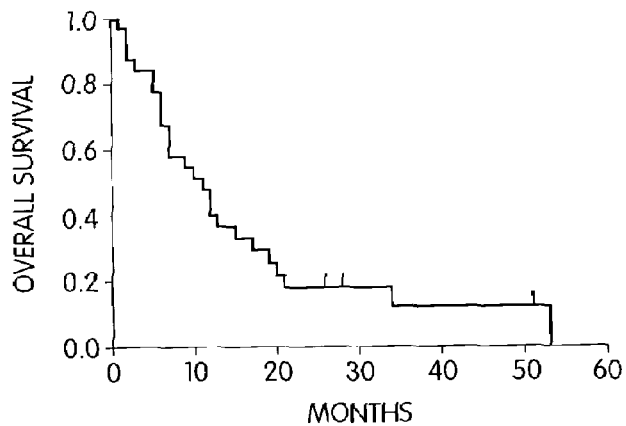
FIG. 6A, overall survival for all 31 patients from which the training set was chosen. The estimated median survival for entire cohort was 11 months.
Figure 6B:
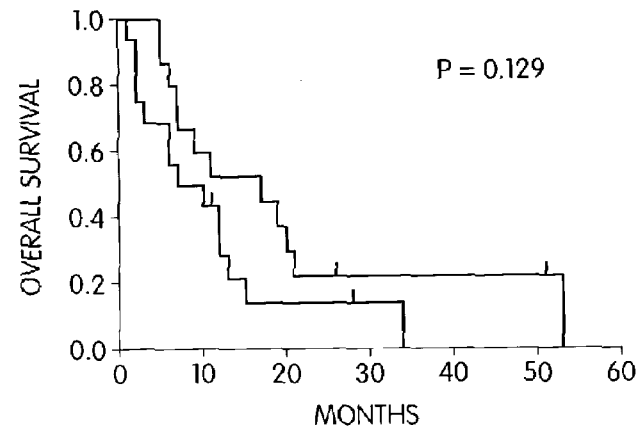
FIG. 6B, overall survival based on the histological subtype of the tumor. The top line represents epithelial subtype tumors (median survival=17 months) and the bottom line represents non-epithelial subtype tumors (median survival=8.5 months). Although epithelial subtype tumors tend to favor longer survival, prediction of outcome in this manner is highly inexact and not accurate for individual samples.

Identification of prognostic molecular markers in mesothelioma. We have previously identified for study a representative cohort of 31 mesothelioma tumors obtained at pneumonectomy (17). The estimated median patient survival (11 months, FIG. 6A) and histological distribution of this group mirror those of mesothelioma patients in our practice (6). The histological subtype of the tumor was not predictive of outcome for these samples (P=0.129, log-rank test, FIG. 6B), even though the estimated median survival of epithelial subtypes samples (17 months) was longer than that for non-epithelial subtype samples (8.5 months). To identify genes that are discriminatory between tumors from patients with widely divergent survival and to create an expression ratio-based predictor model, we utilized microarray data (17) for mesothelioma samples that originated from patients whose survival was within the 25$^{th}$ percentile of both disease-related survival extremes irrespective of tumor histological subtype (i.e., the training set, n=17, Table 9A). We formed two groups using these samples: relatively good outcome (survival ≧17 months, n=8) and relatively poor outcome (survival ≦6 months, n=9). The most accurate model developed in the training set was subsequently tested in an independent cohort of samples (i.e. the test set, n=29, Table 9B). We searched all of the genes represented on the microarray for those with a statistically significant ≧2-fold difference in average expression levels between good outcome and poor outcome tumors in the training set of samples. To minimize the effects of background noise, the list of distinguishing genes was further refined by requiring that the mean expression level be >500 in at least one of the two sample sets. We identified a total of 46 prognostic genes in this analysis with an estimated false discovery rate of 10%-20%. The 10 genes with the lowest P values overexpressed in each group are listed in Table 10.

TABLE 9A

Clinical characteristics of MPM tumors, Training Set
Training Set

| Sample | Age (years) | Sex | Histology[a] | BWH Stage | Survival (months) | Status[b] |
|---|---|---|---|---|---|---|
| 72 | 46 | m | mixed | 2 | 53 | 3 |
| 74 | 40 | f | ept | 1 | 51 | 2 |
| 90 | 48 | m | ept | 2 | 28 | 2 |
| 2 | 44 | f | ept | 2 | 26 | 2 |
| 68 | 61 | m | ept | 2 | 21 | 3 |
| 33 | 60 | f | ept | 2 | 20 | 3 |
| 109 | 62 | m | ept | 2 | 19 | 3 |
| 76 | 67 | m | ept | 1 | 17 | 3 |
| 130 | 55 | m | mixed | 2 | 6 | 3 |
| 166 | 66 | m | sarc | 2 | 6 | 3 |
| 67 | 49 | f | ept | 2 | 6 | 3 |
| 229 | 33 | f | ept | 2 | 5 | 3 |
| 6 | 39 | m | ept | 2 | 5 | 3 |
| 89 | 55 | m | mixed | 2 | 3 | 3 |
| 133 | 69 | m | mixed | 2 | 2 | 3 |
| 114 | 51 | m | mixed | 2 | 2 | 3 |
| 159 | 62 | m | sarc | 2 | 2 | 3 |

[a]ept., epithelial; sarc., sarcomatoid
[b]1, alive without disease; 2, alive with disease; 3, dead with disease; 4, dead other causes; U, unknown

TABLE 9B

Clinical characteristics of MPM tumors, Test Set
Test Set

| Sample | Age (years) | Sex | Histology[a] | BWH Stage | Survival (months) | Status[b] |
|---|---|---|---|---|---|---|
| 169 | 46 | m | ept | 2 | 7 | 3 |
| 146 | 67 | m | ept | 2 | 7 | 3 |
| 219 | 39 | m | ept | 2 | 6 | 1 |
| 104 | 40 | m | ept | 2 | 5 | 3 |
| 110 | 64 | m | ept | 2 | 5 | 3 |
| 112 | 31 | m | ept | 2 | 55 | 3 |
| 165 | 51 | m | ept | 2 | 27 | 2 |
| 5 | 51 | m | ept | 2 | 8 | 3 |
| 148 | 51 | m | ept | 2 | 17 | 3 |
| 96 | 40 | m | ept | 2 | 1 | 3 |
| 134 | 56 | m | ept | 2 | 1 | 4 |
| 216 | 43 | f | ept | 2 | 8 | 1 |
| 208 | 63 | f | ept | 2 | 7 | 1 |
| 224 | 68 | f | ept | 2 | 6 | 1 |
| 225 | 35 | f | ept | 2 | 42 | 2 |
| 163 | 68 | f | ept | 2 | 25 | 1 |
| 235 | 46 | m | mixed | 2 | 24 | 3 |
| 206 | 45 | m | mixed | 2 | 45 | 2 |
| 107 | 69 | m | mixed | 2 | 16 | 3 |
| 302 | 55 | m | mixed | 2 | 13 | 3 |
| 161 | 59 | m | mixed | 2 | 12 | 3 |
| 220 | 71 | m | mixed | 2 | 12 | 3 |
| 217 | 57 | m | mixed | 1 | 5 | 1 |
| 150 | 58 | m | mixed | 2 | 3.6 | 3 |
| 44 | 57 | m | mixed | 2 | 2 | 4 |
| 222 | 57 | m | mixed | 2 | 1 | U |
| 154 | 56 | f | mixed | 2 | 9 | 3 |
| 70 | 57 | m | sarc. | 2 | 8 | 3 |
| 228 | 73 | m | sarc. | 2 | 4 | 3 |

[a]ept., epithelial; sarc., sarcomatoid
[b]1, alive without disease; 2, alive with disease; 3, dead with disease; 4, dead other causes; U, unknown Prediction of outcome using gene expression ratios. We chose the four genes most significantly overexpressed in each group (Table 10) to determine whether expression ratios could accurately classify the 17 samples used to train the model. We calculated a total of 16 possible expression ratios per sample by dividing the expression value of each of the 4 genes (i.e., SBP, KIAA0977 protein, L6 EST, LAR) expressed at relatively higher levels in good outcome samples by the expression value of each of the 4 genes (i.e., CTHBP, calgizzarin, IGFBP-3, GDIA1) expressed at relatively higher levels in poor outcome samples. Samples with ratio values >1 were predicted to be "good outcome" and those with ratio values <1 were predicted to be "poor outcome". The five most accurate ratios singularly identified 88% (15/17) of the samples used to train the model. To incorporate the predictive accuracy of multiple ratios, we calculated the geometric mean (see Methods) for all possible 3-ratio combinations (formed using these 5 ratios) and found that we could identify training samples with accuracy that met or exceeded that of any of the gene pair ratios when used alone (average=94%, range 88%-100%). For further analysis, we chose one of the two 3-ratio combinations that correctly classified 100% (17/17) of the training samples. A total of 4 genes were used in this 3-ratio test: KIAA0977/GDIA1, L6/CTHBP, and L6/GDIA1.

TABLE 10

Mesothelioma prognostic genes

| Accession # | P value | Ratio[a] | Description |
|---|---|---|---|
| | | | Expressed at relatively higher levels in good outcome tumors |
| U29091 | 0.0033 | 2.8 | selenium-binding protein (SBP) |
| AB023194 | 0.0065 | 2.1 | KIAA0977 protein |
| AI445461 | 0.0073 | 3.0 | EST (similar to L6 tumor antigen) |
| Y00815 | 0.0077 | 2.0 | leukocyte antigen related protein (LAR) |
| D84424 | 0.0094 | 6.0 | hyaluronan synthase |
| Y00318 | 0.0103 | 3.6 | complement control protein factor I |
| AL049963 | 0.0103 | 3.7 | EST |
| AJ223352 | 0.0142 | 3.5 | histone H2B |
| AB000220 | 0.0181 | 2.3 | semaphorin E |
| L39945 | 0.0182 | 2.5 | cytochrome b5 (CYB5) |
| M90657 | 0.0256 | 2.8 | L6 tumor antigen |
| AB002301 | 0.0257 | 2.1 | KIAA0303 protein |
| | | | Expressed at relatively higher levels in poor outcome tumors |
| M26252 | 0.0013 | 0.38 | cytosolic thyroid hormone-binding protein (CTHBP) |
| D38583 | 0.0041 | 0.43 | calgizzarin |
| *M35878 | 0.0046 | 0.35 | insulin-like growth factor-binding protein-3 (IGFBP 3) |
| X69550 | 0.0063 | 0.47 | GDP-dissociation Inhibitor 1 (GDIA1) |
| M95787 | 0.0068 | 0.33 | 22kDa smooth muscle protein (SM22), AKA transgelin |
| AB023208 | 0.0069 | 0.49 | KIAA0991 protein |
| X95735 | 0.0105 | 0.43 | zyxin |
| AA976838 | 0.0131 | 0.40 | EST |
| U90878 | 0.0132 | 0.49 | carboxyl terminal LIM domain protein (CLIM1) |
| *M35878 | 0.0135 | 0.30 | insulin-like growth factor-binding protein-3 (IGFBP 3) |
| U53204 | 0.0169 | 0.39 | plectin (PLEC1) |
| M95178 | 0.0215 | 0.40 | non-muscle alpha-actinin |

[a]average expression level in good outcome samples/average expression level in poor outcome samples
*IGFBP-3 is listed twice in the lower portion of the table because this gene is represented by multiple Affymetrix probe sets.

Figure 6C:
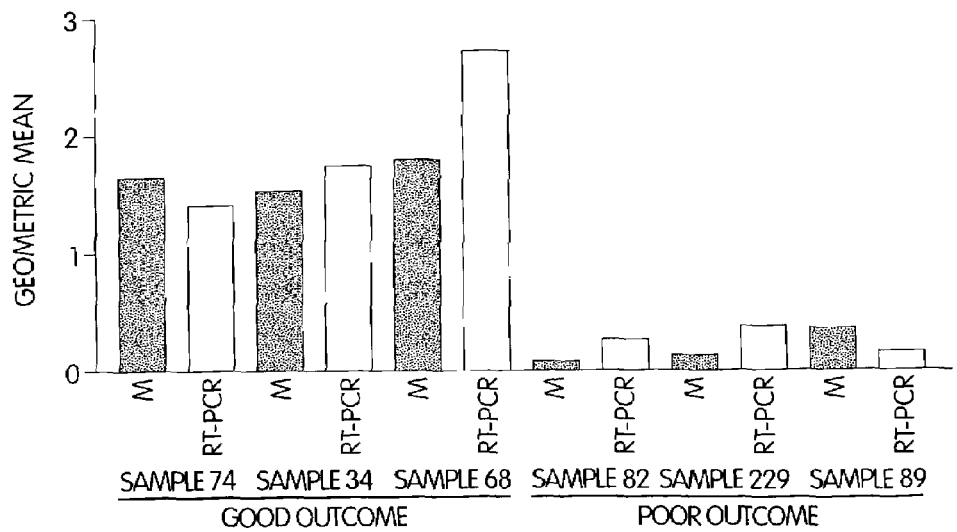
FIG. 6C, geometric mean values obtained for 6 randomly chosen samples (3 each from good and poor outcome groups) using quantitative RT-PCR confirmed microarray data (M).

Verification of microarray data. Next, we utilized quantitative RT-PCR to verify gene expression levels measured in microarray-based analysis. We randomly chose 3 samples each from both groups: the good outcome group (samples 74, 33, and 68) and the poor outcome group (samples 89, 229, and 67). Using RT-PCR, we determined the relative expression level of all 4 prognostic genes (L6, GDI, CTHBP, and KIAA0977 protein) in these 6 samples. Then, we calculated the 3 individual ratios previously used to predict outcome: KIAA0977/GDIA1, L6/CTHBP, and L6/GDIA1. Finally, we calculated the geometric mean of these 3 ratios and compared the magnitude and direction (i.e. >1 or <1) of this number to that obtained using microarray analysis. We found that classification using the 3-ratio geometric means calculated with data from both platforms were in perfect agreement for all 6 samples (FIG. 6C).

Validation of the model. We utilized a "leave-one-out" cross validation technique (16,19,20) to assess the internal variation of a 3-ratio predictor model. For this analysis, we analyzed 17 different training sets by withholding 1 of the 17 samples to construct a new expression ratio-based classifier exactly as before and then predicting the class (either good or poor outcome) of the withheld sample. This process was repeated sequentially for the remaining 16 samples. We found that 88% (15/17) of the samples were correctly identified in this analysis (P=0.0034, Fisher's exact test).

Figure 7A:
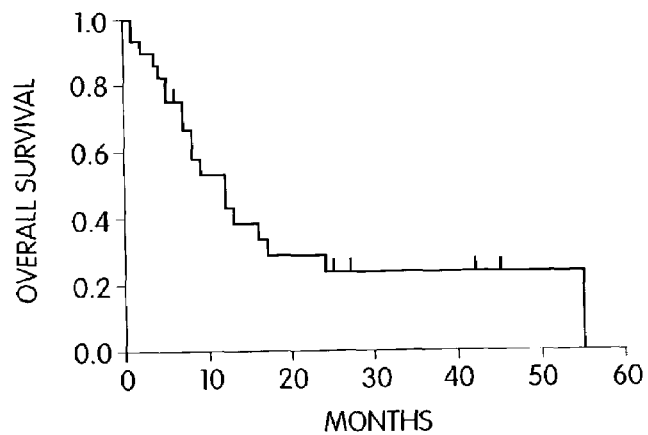
FIG. 7A, overall survival for 29 independent mesothelioma patients. Similar to the initial 31 samples, the estimated median survival for this cohort was 12 months.
Figure 7B:
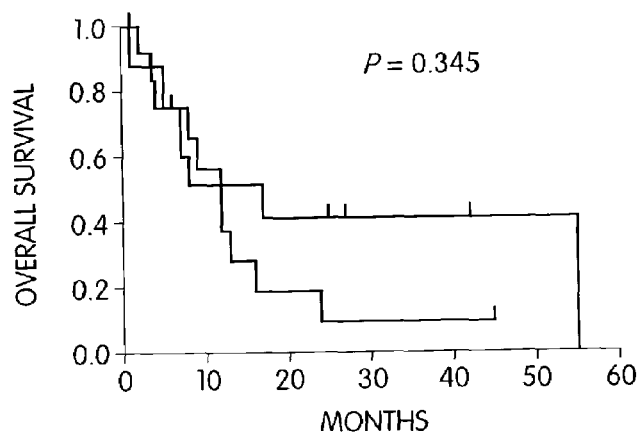
FIG. 7B, overall survival based on the histological subtype of the tumor. The median survival of epithelial subtype tumors (top line, median survival=17 months) and non-epithelial subtype tumors (bottom line, median survival=12 months) in the new sample set was identical to that for the previous 31 samples and was equally insufficient for predicting outcome.
Figure 7C:
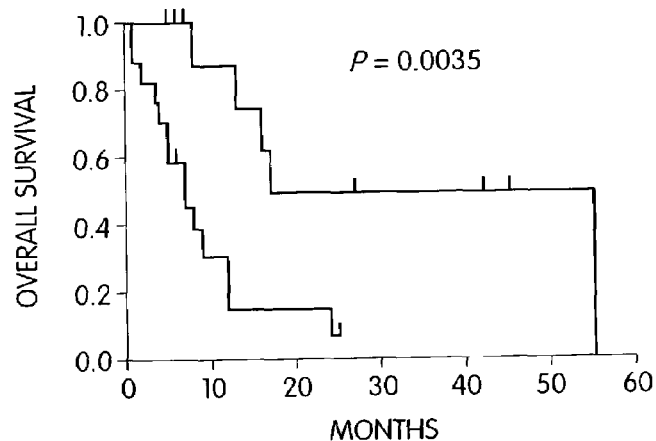
FIG. 7C overall survival in the new set of samples for good outcome (top line, median survival=36 months) and poor outcome (bottom line, median survival=7 months) groups as defined by the 4 gene expression ratio model (utilizing RT-PCR for data acquisition). The 4-gene expression ratio model significantly (P=0.0035) predicts outcome in mesothelioma in an independent set of 29 samples.

Verification of expression level ratios as outcome predictors. Finally, we tested the ability of expression ratios to predict outcome in a new cohort of mesothelioma tumor samples not subjected to microarray analysis (n=29, the test set, Table 9B). The histological distribution and the estimated median patient survival (12 months, FIG. 7A) of the test set of samples was also representative of those of mesothelioma patients in our practice (6). As before, we found that histological subtype was not strongly predictive of survival in the new cohort of samples (P=0.345, log-rank test, FIG. 7B). We used quantitative RT-PCR to determine relative expression levels for the 4 predictor genes and calculated the geometric mean of 3 prognostic ratios: KIAA0977/GDIA1, L6/CTHBP, and L6/GDIA1. Similarly, samples with geometric means >1 and <1 were assigned to good outcome and poor outcome groups, respectively. A total of 11 samples were assigned to the good outcome group and 18 to the poor outcome group. The number of test set samples "correctly" classified was estimated using the median survival (12 months) of the entire cohort as a cut-off to form 2 groups: relatively good outcome (>12 month survival) and relatively poor outcome ($\leq$12 month survival). Only those 17 samples from patients that died from disease were considered (status 3, Table 9). We found that the exact same number of test set samples were classified correctly in this analysis (88%, 15/17) as in the analysis of the training set. To include all samples in the assessment of the model, we performed Kaplan-Meier survival analysis using expression ratio predictions made for the test set of samples. The estimated median survival for the good outcome group (36 months) was over 5-fold higher than that for the poor outcome group (7 months). In addition, we found that the 3-ratio geometric mean model significantly (P=0.0035, log-rank test, FIG. 7C) predicted outcome in the new set of samples. Since it has been demonstrated in very large sample cohorts that patients with epithelial histology generally enjoy significantly longer disease-free survival than patients with non-epithelial histology (22), we used multivariate analysis to examine whether our results using expression ratios were independent of the histological subtype of the tumor. By fitting a Cox proportional-hazards regression model, we found that the (3-ratio) geometric mean value significantly predicts outcome (P=0.0094, hazard ratio=2.6) independent of the histological subtype of the tumor (P=0.75, hazard ratio=0.32). Expression ratios correctly predicted outcome independently of the histological subtype of the tumor in the new set of samples, indicating the ratio method is a better prognostic tool.

Discussion

Current methods of prognosis in mesothelioma include stage and histology at the time of surgery. However, these techniques are not completely reliable and accurate staging usually requires extensive surgery (3,8,9). Recently, we discovered that simple ratios of gene expression can be used to accurately diagnose cancer (17) while successfully avoiding many of the shortcomings which preclude the use of other microarray analytical techniques in wider clinical applications (10,20). In this study, we describe a technique that uses expression data from four genes to independently predict outcome in mesothelioma patients who undergo extrapleural pneumonectomy followed by standard chemoradiation therapy. Although this analysis only utilized four genes, the expression ratio technique can easily incorporate larger numbers of genes when required for acceptable accuracy. To our knowledge, this is the first study in human cancer to use expression profiling techniques to identify treatment related prognostic markers in cancer for use in the development of an outcome predictor model, and to validate the model in an independent cohort using a simpler data acquisition platform such as RT-PCR. Other investigators have tested outcome predictor models in independent samples (16), but studies of this sort continue to be hindered in their clinical applicability through their reliance on relatively large numbers of genes, costly data acquisition platforms (i.e. microarrays), the need for sophisticated algorithms/software, and the inability to analyze a sample independently and without reference to other samples.

The prognostic tool described herein could dramatically impact the current clinical treatment of mesothelioma by identifying preoperatively patients not likely to respond to conventional treatment modalities thus sparing them from radical surgery. It is currently our practice to obtain a tissue diagnosis prior to recommending therapy for patients with mesothelioma, but the absence of suitable prognostic molecular markers make it difficult to assign optimal treatments or investigate new modalities. The results of this work, if confirmed prospectively in a larger patient population, should prove helpful in the development of meaningful clinical trials for patients with mesothelioma. We hypothesize that patients whose tumors are analyzed using gene expression ratios and predicted to have relatively poor outcomes are excellent candidates for neo-adjuvant chemotherapy protocols as they are unlikely to benefit from upfront surgery, whereas patients predicted to have relatively good outcomes are more likely to enjoy long term survival after conventional surgical and adjuvant chemoradiation. The use of gene expression ratios to predict patient outcome in mesothelioma and other cancers (17) overcomes several major obstacles to the clinical use of microarray data. Unlike other widely accepted supervised learning techniques with similar predictive accuracy (10,16, 20), the expression ratio method generates a simple numerical measure that can be used to predict clinical outcome using a single biopsy specimen. Since this non-linear function of gene expression is a unit-less number and does not require data from additional training samples or from additional reference genes, expression levels can be measured using any reliable method including quantitative RT-PCR, cDNA and oligonucleotide microarrays, SAGE, or perhaps ELISAs for encoded proteins. The expression ratio technique can also facilitate examination of microarray data by investigators without direct access to sophisticated analytical tools. Using previously published data, we have created ratio-based tests using small numbers of genes that can diagnose localized prostate cancer and predict clinical outcome in breast cancer (see Example 4).

We believe that attempts to bridge the gap between expression profiling studies in cancer and meaningful clinical applications should follow the general spirit of Occam's Razor principle: "among a set of otherwise equal models, choose the simplest". Although other microarray-based predictor models in cancer may utilize relatively small numbers of genes to accurately predict outcome (16,19,20), these approaches continue to be limited in their clinical applicability. Furthermore, it has yet to be determined if these approaches can utilize relatively low-cost and widely available data acquisition platforms such as RT-PCR and retain significant survival predictions. The expression ratio technique is fundamentally similar to other widely accepted bioinformatics techniques (10) in that it utilizes genes with inversely correlated expression levels in multiple groups. The principal advantages to the use of expression ratios in predicting clinical parameters is their relative simplicity, platform independence for data acquisition, and requirement for small quantities of fresh or frozen tissue for analysis. In addition, these tests are relatively low cost and can be used to analyze samples independent of a training set. For this reason, it is likely that the expression ratio technique will find additional uses in the clinical management of other cancers and diseases.

References for Example 3

1. Pass H. Malignant pleural mesothelioma: Surgical roles and novel therapies. Clin Lung Cancer 2001;3:102-117.
2. Aisner J. Diagnosis, staging, and natural history of pleural mesothelioma. In:Aisner J, Arriagada R, Green M R, et al, Aisner J, Arriagada R, Green M R, et als. Comprehensive Textbook of Thoracic Oncology. Baltimore (Md.): Williams and Wilkins; 1996.799-785.
3. Ong S-T, Vogelsang N J. Current therapeutic approaches to unresectable (primary and recurrent) disease. In:Aisner J, Arriagada R, Green M R, et al, Aisner J, Arriagada R, Green M R, et als. Comprehensive Textbook of Thoracic Oncology. Baltimore (Md.): Williams and Wilkins; 1996.799-814.
4. Peto J, Hodgson J T, Matthews F E, Jones J R. Continuing increase in mesothelioma mortality in Britain. Lancet 1995;345:535-539.
5. Sugarbaker D J, Flores R M, Jaklitsch M T, Richards W G, Strauss G M, Corson J M, et al. Resection margins, extrapleural nodal status, and cell type determine postoperative long-term survival in trimodality therapy of malignant pleural mesothelioma: results in 183 patients. J Thorac Cardiovasc Surg 1999;117:54-65.
6. Sugarbaker D J, Garcia J P, Richards W G, Harpole D H, Jr., Healy-Baldini E, DeCamp M M, Jr., et al. Extrapleural pneumonectomy in the multimodality therapy of malignant pleural mesothelioma. Results in 120 consecutive patients. Ann Surg 1996;224:288-294.
7. Sugarbaker D, Strauss G M, Lynch T J, Richards W, Mentzer S J, Lee T H, et al. Node status has prognostic significance in the multimodality therapy of diffuse, malignant mesothelioma. J Clin Oncol 1993;11:1172-1178.
8. Corson J M, Renshaw A A. Pathology of mesothelioma. In:Aisner J, Arriagada R, Green M R, et al, Aisner J, Arriagada R, Green M R, et als. Comprehensive Textbook of Thoracic Oncology. Baltimore (Md.): Williams and Wilkins; 1996.757-758.
9. Ordonez N G. The value of antibodies 44-36A, SM3, HBME-1, and thrombomodulin in differentiating epithelial pleural mesothelioma from lung adenocarcinoma. Am J Surg Pathol 1997;21:1399-1408.
10. Golub T R, Slonim D K, Tamayo P, Huard C, Gaasenbeek M, Mesirov J P, et al. Molecular classification of cancer: class discovery and class prediction by gene expression monitoring. Science 1999;286:531-537.
11. Perou C M, Sorlie T, Eisen M B, van de Rijn M, Jeffrey S S, Rees C A, et al. Molecular portraits of human breast tumours. Nature 2000;406:747-752.
12. Hedenfalk I, Duggan D, Chen Y, Radmacher M, Bittner M, Simon R, et al. Gene expression profiles in hereditary breast cancer. N Engl J Med 2001;344:539-548.
13. Khan J, Wei J S, Ringner M, Saal L H, Ladanyi M, Westermann F, et al. Classification and diagnostic prediction of cancers using gene expression profiling and artificial neural networks. Nat Med 2001;7:673-679.
14. Welsh J B, Sapinoso L M, S u A I, Kern S G, Wang-Rodriguez J, Moskaluk C A, et al. Analysis of gene expression identifies candidate markers and pharmacological targets in prostate cancer. Cancer Res 2001;61:5974-5978.
15. Dhanasekaran S M, Barrette T R, Ghosh D, Shah R, Varambally S, Kurachi K, et al. Delineation of prognostic biomarkers in prostate cancer. Nature 2001;412:822-826.

16. van 't Veer L J, Dai H, van de Vijver M J, He Y D, Hart A A M, Mao M; et al. Gene expression profiling predicts clinical outcome of breast cancer. Nature 2002;415:530-536.
17. Gordon G J, Jensen R V, Hsiao L-L, Gullans S R, Blumenstock J E, Ramaswami S, et al. Translation of microarray data into clinically relevant cancer diagnostic tests using gene expression ratios in lung cancer and mesothelioma. Cancer Res 2002;In Press.
18. Tusher V G, Tibshirani R, Chu G. Significance analysis of microarrays applied to the ionizing radiation response. Proc Natl Acad Sci USA 2001;98:5116-5121.
19. Pomeroy S L, Tamayo P, Gaasenbeek M, Sturla L M, Angelo M, McLaughlin M E, et al. Prediction of central nervous system embryonal tumor outcome based on gene expression. Nature 2002;415:436-442.
20. Shipp M A, Ross K A, Tamayo P, Weng A P, Kutok J L, Aguiar R C T, et al. Diffuse large B-cell lymphoma outcome prediction by gene expression profiling and supervised machine learning. Nat Med 2002;8:68-74.
21. Venables W N, Riley B D: Modem Applied Statistics with S-Plus. New York (NY): Springer; 1997.
22. Sugarbaker D J, Liptay M J. Therapeutic approaches in malignant mesothelioma. In:Aisner J, Arriagada R, Green M R, et al, Aisner J, Arriagada R, Green M R, et als. Comprehensive Textbook of Thoracic Oncology. Baltimore (MD): Williams and Wilkins; 1996.786-798.

Example 4

Diagnostic and Prognostic Tests in Prostate and Breast Cancer From Expression Profiling Data Current gene expression profiling-based bioinformatics tools are highly accurate in the diagnosis and prognosis of cancer (1-6). However, the widespread clinical applicability of these techniques is currently limited owing largely to a lack of a practical method for translating complex profiling analyses to functional clinical tests. To address this issue, we have created a simple yet effective technique with broad and immediate clinical applicability for performing relatively low cost diagnosis and prediction of prognosis in cancer (see Examples above and reference 7). Our method utilizes a supervised comparison of extensive gene profiling data to identify differentially expressed genes between two groups. Carefully chosen genes are then used to calculate simple expression ratios which in turn are set to predict (in a binary numerical manner) the clinical parameter in question. To date, we have demonstrated the applicability of this method in distinguishing mesothelioma from lung adenocarcinoma (see Examples above and reference 7), in identifying patients with favorable prognosis after surgery for mesothelioma, and in predicting patients with favorable outcome after treatment for medulloblastoma (see Examples above and reference 7). In this study, we have tested the accuracy of ratio-based predictions in two separate applications: the diagnosis of prostate cancer and the prediction of clinical outcome in early stage, node-negative resected breast cancer. By using multiple previously published datasets to train and validate our predictor models, we have also directly tested the hypothesis that this gene expression ratio technique is platform independent and can be utilized in widespread fashion by large numbers of clinical and translational investigators.

Methods

Tumor tissues. Ten sets of matched normal adjacent prostate and malignant prostate cancer (20 specimens total) were obtained from the Tumor Bank at Brigham and Women's Hospital. Studies utilizing human tissues were approved by and conducted in accordance with the policies of the Institutional Review Board at Brigham and Women's Hospital.

Figure 8:
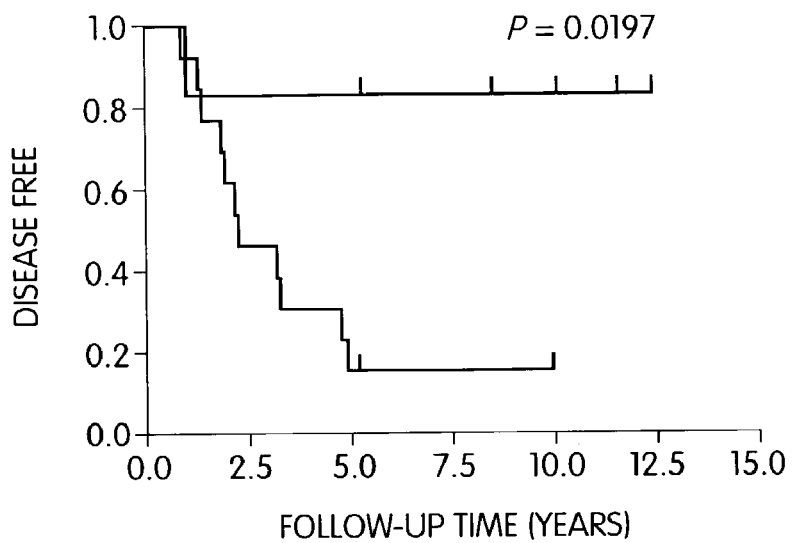
FIG. 8 shows Kaplan-Meier disease-free survival predictions for breast cancer patients. Time to relapse for patients predicted to be good prognosis (top line) and poor prognosis (bottom line) using a 6-ratio model in the test set of samples (n=19). Hash marks indicate censored data.

Expression profiling data. Microarray data for prostate tissues was obtained from two sources. Gene expression data composing the initial "training set" were obtained using a 9,984-element cDNA microarray (12) and consisted of PCA (n=14) and a group (n=18 total) composed of both NAP (n=4) and BPH (n=14) tissues (Supplemental FIG. 8 Data). When there was no data for a given gene due to a technical artifact, we conservatively assumed no change in expression level from the pooled reference mRNA. Gene expression data composing the initial "test set" were obtained using Affymetrix high-density oligonucleotide microarrays with probe sets representing approximately 12,000 genes (13) and consisted of NAP (n=9) and PCA (n=25) tissues. For this dataset, we scaled gene hybridization intensities (i.e. ".cel" files) to a "target intensity" of 100 using Affymetrix GeneChip® Software, v.5.0 (Affymetrix, Santa Clara, Calif.). Gene expression data for breast cancer tissues were obtained from a single source using a microarray containing approximately 25,000 genes (6). The "training set" consisted of two groups of samples: those from 44 patients with greater than 5 years disease-free survival (i.e., relatively good outcome) and those from 34 patients with less than 5 years disease-free survival (i.e., relatively poor outcome). The "test set" consisted of 19 additional profiled patient samples.

Real time quantitative RT-PCR. Quantitative RT-PCR was performed as described in the examples above and in reference (7). Primer sequences were as follows:

```
HPN    5'-AATACATCCAGCCTGTGTGC-3'    (SEQ ID NO:95)
       and

5'-TGGCCATAGTACTGCGTGTT-3';   (SEQ ID NO:96)

MEIS2  5'-TTAGCGCAAGACACAGGACT-3'    (SEQ ID NO:97)
       and

5'-CACTCGTCGATTTGACTGGT-3';   (SEQ ID NO:98)

C7     5'-TCAAAATGGTGGTTTGGCTA-3'    (SEQ ID NO:99)
       and

5'-CCTACGAGGACTCCTTGCTC-3';   (SEQ ID NO:100)
       and

FN1    5'-GCCATGACAATGGTGTGAAC-3'    (SEQ ID NO:101)
       and

5'-GCAAATGGCACCGAGATATT-3'.   (SEQ ID NO:102)
```

Data and statistical analysis. The selection of predictor genes for use in expression ratio-based diagnosis and prognosis was performed essentially as described in the examples above and in reference (7). Basically, a two-sided Student's (parametric) t-test was used for pair-wise comparisons of average gene expression levels among multiple groups to select predictor genes that have highly significant, inversely correlated average expression levels. Data from multiple highly accurate gene expression ratios were combined by calculating the geometric mean, thereby giving equal weight to ratio fold-changes of identical magnitude but opposite direction. The classification accuracy of selected ratios was assessed using Fisher's exact test. Kaplan-Meier time-to-relapse analysis was used to assess disease-free survival. The log-rank test was used to statistically assess differences among multiple survival curves. All differences were determined to be statistically significant if P<0.05. All calculations and statistical comparisons were generated using S-PLUS (14).

Results and Discussion

Diagnosis of prostate cancer using gene expression ratios. Prostate cancer is exceedingly common among males in the U.S. (8). Unfortunately, widespread serum prostate-specific antigen (PSA) screening has been found to present major drawbacks (9-11). For this reason, patients who are PSA-positive and at a moderate or high risk for prostate cancer undergo a core needle biopsy of the prostate for definitive diagnosis, a procedure associated with substantial patient discomfort. To improve the diagnostic accuracy, decrease the discomfort, and reduce the resulting non-compliance associated with current methodology, we explored the feasibility of designing a less invasive diagnostic test for prostate cancer. To accomplish this, we designed an expression ratio-based test which would utilize RT-PCR for data acquisition, and by virtue of the quantity of RNA needed (e.g., <100 pg), would likely support sample attainment using fine needle aspirations (FNA).

We identified two published reports that provide extensive gene profiling data from prostate cancer and non-malignant prostate tissues (12, 13). We used data from one manuscript to develop our training set and data from the other as our test set (see Methods for details). To create an expression ratio-based diagnostic test capable of distinguishing prostate cancer (PCA) from either normal adjacent prostate or benign prostatic hypertrophy (NAP and BPH, respectively) we first identified a total of 19 known genes with inversely correlated average expression levels in the training set that matched our filtering criteria (P<0.01, at least a 2-fold difference in mean expression levels between PCA and NAP/BPH). We chose 11 of these genes for further analysis since they were also represented on the expression profiling platform of the test set (Table 11).

relatively higher levels in PCA. Then, we tested the diagnostic accuracy of these ratios in the 28 training set samples obtained from the same study. Samples with ratio values >1 were called NAP/BPH and those with ratio values <1 were called PCA. Not surprisingly, we found that these 30 ratios could be used to correctly distinguish between non-malignant tissues and PCA with a high degree of accuracy (average=86%, range 76%-100%).

To further refine our diagnostic tool, we examined the expression patterns of the 11 genes identified in the training set in a new cohort of samples (i.e. the test set) for which published data was available from another laboratory. Four genes were discarded because they were not reliably detected in at least one group on the profiling platform of the test set (i.e., average expression level <600 in both NAP and PCA samples). Of the remaining 7 genes, only one (ODC1) was not expressed at significantly different levels in test set samples and was not given further consideration (Table 11). We formed a total of 9 possible ratios from the remaining 6 genes and found that all possessed similarly high accuracy in diagnosing test set samples (average=93%, range 88%-100%). To utilize more than two discriminating genes, we calculated the geometric mean of the 3 most accurate individual ratios and examined the ability of this 3-ratio (4-gene) test, C7/HPN, MEIS2/HPN, and FN1/HPN, to diagnose test set samples. As expected, we found that the accuracy of this 3-ratio test remained high (97%, 33/34). The HPN gene is used in all 3 of the ratios, indirectly corroborating the results of the original analyses of these datasets showing this gene to be highly expressed in PCA (12, 13). Finally, we validated this 3-ratio diagnostic test in an independent set of discarded NAP (n=10) and PCA (n=10) patient specimens using quantitative RT-PCR performed at our institution. We found this technique to be highly accurate (90%, 18/20) in classifying these samples (P=0.0007, Fisher's exact test). In both misclassifications,

TABLE 11

Prostate cancer diagnostic genes

| Accession # | P value training set | P value test set | LocusLink Symbol | Description |
|---|---|---|---|---|
| | | | | Expressed at relatively higher levels in NAP/BPH |
| AA424743 | $1.5 \times 10^{-7}$ | — | BRF1 | butyrate response factor 1 (EGF-response factor 1) |
| AA418773 | $2.3 \times 10^{-7}$ | — | HPS | Hermansky-Pudlak syndrome |
| AA148641 | $2.8 \times 10^{-7}$ | $1.9 \times 10^{-10}$ | MEIS2 | Meis (mouse) homolog 2 |
| R98851 | 0.0012 | — | CALLA | common acute lymphoblastic leukemia antigen |
| AA598478 | 0.0036 | 0.015 | C7 | complement component 7 |
| R62612 | 0.0070 | $9.8 \times 10^{-5}$ | FN1 | fibronectin 1 |
| | | | | Expressed at relatively higher levels in PCA |
| H50323 | $2.5 \times 10^{-8}$ | $7.0 \times 10^{-5}$ | FASN | fatty acid synthase |
| H62162 | $1.0 \times 10^{-6}$ | $1.4 \times 10^{-8}$ | HPN | hepsin |
| AA460115 | $2.8 \times 10^{-6}$ | 0.22 | ODC1 | ornithine decarboxylase 1 |
| N26311 | $3.9 \times 10^{-5}$ | $2.5 \times 10^{-4}$ | PLAB | prostate differentiation factor |
| AA454207 | $3.4 \times 10^{-4}$ | – | LABH2 | putative transmembrane protein |

—these genes were not reliably detected (i.e., average expression levels >600) in at least one group of the test set and were not given further consideration.

Using these 11 genes, we calculated 30 expression ratios per sample by dividing the expression value of each of the 6 genes expressed at relatively higher levels in NAP/BPH by the expression value of each of the 5 genes expressed at normal prostate was diagnosed as PCA, but no PCA specimens were diagnosed as non-cancer.

Despite the fact that diagnostic genes were chosen from a training set in which non-malignant tissues were composed primarily of BPH, the gene ratios remain accurate in distinguishing cancer from the non-malignant samples in the test set which were exclusively NAP. To see if the inverse is true, we reversed the training and test sets and identified predictor genes in exactly the same manner as above. Of the 4 genes used in the diagnostic test from above, only HPN was listed among the 10 most significant genes overexpressed in either group in the new training set. This finding may be attributed to the larger numbers of genes on this training set profiling platform and/or the fact that NAP and BPH do not have perfectly overlapping expression patterns, but enough similarities in key genes to be mutually distinctive from PCA. To test the discriminating nature of these new predictor genes, we chose the 4 genes most significantly overexpressed in each group (8 genes total) and present on both profiling platforms (LocusLink symbol, P value in new training set): DJ742C19.2, $P=10^{-13}$, FHL1, $P=4.8\times10^{-12}$, SEC23A, $P=7.5\times10^{-11}$, ATP2A2, $P=10^{-10}$, HPN, $P=1.3\times10^{-8}$, KLK3, $P=1.3\times10^{-6}$, LU, $P=3.7\times10^{-6}$, LIM, $P=4.0\times10^{-6}$. In the new test set, we discovered that 4 of these 8 genes were expressed at significantly different levels: HPN($P=10^{-6}$), SEC23A ($P=3.4\times10^{-4}$), and LIM ($10^{-4}$), and KLK3 ($P=0.049$). As before, a total of 16 possible ratios were calculated using these 8 genes and used to diagnose samples in the new test set. The accuracy of these ratio varied greatly (average=75%, range 41%-91%). We combined the four most accurate individual ratios ($\geqq=88\%$ accuracy) and found that this 4-ratio test was actually slightly less accurate (84%, 27/32) than any single ratio. No normal samples were misdiagnosed in this test and three of the five errors resulted from BPH samples diagnosed as PCA. These observations combine to suggest that genes found to be discriminatory between BPH and PCA are effective in distinguishing between NAP and PCA, but the reverse is less likely to result in accurate stratification. Another, possible explanation is that the platform used in the second set of experiments is not sufficiently extensive to include the best diagnostic genes for this application. Nevertheless, the gene ratio technique was effective in producing relatively accurate and cancer sensitive diagnostic tests across two platforms and in both directions.

Prediction of prognosis in breast cancer using gene expression ratios. Breast cancer is the most common malignancy in women (in 2001) and is the second highest cause of cancer death in North American women (www.cancer.org). Breast cancer gene expression signatures have recently been used to stratify tumor samples into prognostic groups based on cancer recurrence (6). In this context, tumors were obtained from women who underwent surgical resection for lymph node negative breast cancer. "Good prognosis" was defined as disease-free survival for at least 5 years and "poor prognosis" was defined as the development of distant metastases within a 5 year period. An optimal 70-gene classifier was identified and validated in an independent set of tumors. Although the classifier described in this manuscript appears highly accurate and reproducible, there are several limitations to the rapid incorporation of these results into a clinically relevant test. For one, van 't Veer and colleagues ranked tumors for comparison to classification thresholds by comparing the correlation of predictor genes to the average "good prognosis" profile taken from data acquired on the same platform. This relative measure of contrast relies upon absolute expression levels obtained using microarrays. Unfortunately, it is not certain that an alternative data acquisition platform will produce similarly accurate results. Also, by definition, this technique cannot classify an individual sample without reference to data from additional samples.

We hypothesized that the expression ratio technique could classify samples with similar or greater accuracy to that described by van 't Veer et al. while requiring substantially fewer genes. To test this hypothesis, we identified predictor genes with inversely correlated average expression levels in the same training set as used by van 't Veer et al. and composed of good prognosis samples (n=44) and poor prognosis samples (n=34). We found 8 genes that fit our filtering criteria ($P<0.01$, at least a 2-fold difference in mean expression levels), 4 genes each overexpressed in good and poor prognosis samples (Table 12). We calculated all 16 possible expression ratios per training set sample by dividing the expression value of each of the 4 genes expressed at relatively higher levels in good prognosis samples by the expression value of each of the 4 genes expressed at relatively higher levels in poor prognosis samples. Samples with ratio values >1 were classified as good prognosis and those with ratio values <1 were classified as poor prognosis. The classification accuracy of these 16 ratios in the training set varied widely (average=70%, range 59%-80%) so we determined the classification accuracy of multiple ratios combined in a single test. Beginning with the three most accurate ratios, we added additional ratios in descending order of accuracy to form a total of three multiple-ratio tests. These tests used 3, 4, and 6 individual ratios and were 85%, 83%, and 84% accurate in the training set, respectively, demonstrating that the combination of multiple ratios in this analysis exceeds the classification accuracy of the single most accurate individual ratio. (The 6-ratio test incorporated two additional equally accurate ratios.) Only one of eight predictor genes (ASAH2) was not used in any of the three multiple-ratio tests.

TABLE 12

Breast cancer prognostic genes

| $^a$Gene ID | P value | LocusLink Symbol | Description |
|---|---|---|---|
| | | | Expressed at relatively higher levels in good prognosis |
| NM_003862 | $1.7 \times 10^{-4}$ | FGF18 | fibroblast growth factor 18 |
| *Contig47178_RC | $3.6 \times 10^{-3}$ | — | EST |
| NM_003147 | $4.9 \times 10^{-3}$ | SSX2 | synovial sarcoma, X breakpoint 2 |
| NM_019893 | $6.5 \times 10^{-3}$ | ASAH2 | N-acylsphingosine amidohydrolase (non-lysosomal ceramidase) 2 |

TABLE 12-continued

Breast cancer prognostic genes

| [a]Gene ID | P value | LocusLink Symbol | Description |
|---|---|---|---|
| | | | Expressed at relatively higher levels in poor prognosis |
| AL080059 | $2.0 \times 10^{-6}$ | KIAA1750 | KIAA1750 protein |
| NM_006681 | $4.0 \times 10^{-5}$ | NMU | neuromedin U |
| *Contig29050_RC | $5.1 \times 10^{-3}$ | — | EST |
| NM_000340 | $7.7 \times 10^{-3}$ | SLC2A2 | solute carrier family 2 (facilitated glucose transporter), member 2 |

[a]sequences in training set expression profiling platform were identified by their GenBank Accession number or EST contig number (6).
—not available
*these sequences were not homologous to any known genes at the time of this study (BLAST search, www.ncbi.nlm.nih.gov/BLAST/)

We then examined these three multiple-ratio tests in the same test set used by van 't Veer which consisted of 19 additional samples: 7 good prognosis samples and 12 poor prognosis samples (6). We discovered that all 3 sets of gene ratio tests were able to distinguish test set samples with at least 80% accuracy. The most successful gene ratio combination correctly identified 84% (16/19) of the test set samples (P=0.0055, Fisher's exact test) utilizing 5 genes (from Table 12) in 4 ratios: SSx2/KIAA1750, Contig47178_RC/KIAA1750, FGF18/KIAA1750, and FGF18/NMU. These results are nearly as accurate as those obtained with the optimized 70-gene classifier developed by van 't Veer and colleagues for the same dataset (6). Their classifier correctly identified 17/19 samples but required an 65 additional genes.

We performed a final analysis of the gene profiling data obtained from breast cancer tissues to develop a model optimized for sensitivity. As noted by van 't Veer and colleagues (6), it is desirable for therapeutic purposes to minimize the number of poor prognosis samples assigned to the good prognosis category in order to ultimately capture all patients at risk of recurrence for adjuvant systemic therapy. Since all three misclassified samples in our best 4-ratio test were samples obtained from patients with poor prognosis, we analyzed multiple-ratio tests exactly as above, with the exception that individual ratios were ranked according to classification accuracy in the poor prognosis group only. As predicted, these tests accurately classified poor prognosis samples, but we discovered that they also remained relatively accurate overall (poor prognosis accuracy, overall accuracy): 3 ratios (91%, 75%), 5 ratios (88%, 82%), and 6 ratios (91%, 83%). (Two equally accurate ratios were added to the 3-ratio test). In the test set of samples, the 3- and 5-ratio tests misclassified only 1 of 12 poor prognosis samples, but each resulted in 4 misclassifications overall (79%, 15/19). The 6-ratio test also resulted in accurate identification of 11 of 12 poor prognosis patients and only 3 overall errors (84%, 16/19, P=0.00954, Fisher's exact test) using 6 genes (from Table 12): FGF18/SLC2A2, FGF18/Contig29050_RC, SSx2/SLC2A2, SSx2/Contig29050_RC, FGF18/KIAA1750, and FGF18/NMU. We performed Kaplan-Meier time-to-relapse analysis using predictions made from this test in the 19 test set samples and found a significant difference (P=0.0197, FIG. 8) between groups predicted to have widely divergent disease-free survival times. These results indicate that ratios chosen for enhanced sensitivity perform similarly well in the test set samples without any substantial sacrifice in overall accuracy. There are two individual ratios in common between this 6-ratio test and the best 4-ratio test we used to initially develop a classifier based only on overall accuracy. Although both tests resulted in only 3 misclassifications in the test set (n=19), we found the 6-ratio test to be more sensitive.

It is important to note that we have not proposed an exact protocol for developing and testing ratio-based predictor models. In fact, we discovered in this study and others (7) that multiple combinations of genes, in the form of ratios, can achieve similarly accurate results. We merely assert that simple ratios can be a highly accurate means of predicting clinical parameters using very small numbers of genes and simpler data acquisition platforms, such as quantitative RT-PCR and/or custom microarrays. Furthermore, this strategy can be used to analyze microarrays without the need for additional reference samples. In the case of prostate cancer, we envision diagnosis using mRNA obtained from fine needle aspirations would be less invasive than current biopsy techniques and would likely increase compliance and reduce discomfort in men whose prostate-specific antigen levels mandate frequent screening. Similarly, women with breast cancer undergoing initial diagnostic biopsy could have tissue saved for a similar gene expression ratio based test using quantitative RT-PCR or a custom microarray. Women found to be at high risk for recurrence may be selected for either neo-adjuvant chemotherapy or post-surgical adjuvant therapy. The gene ratio method thus presents an opportunity to translate initial microarray based gene expression profiling to simple clinical tests that are performed using quantitative RT-PCR, microarrays, or other platforms on material obtained surgically or from fine needle aspirations.

References for Example 4

1. Shipp, M. A., Ross, K. A., Tamayo, P., Weng, A. P., Kutok, J. L., Aguiar, R. C. T., Gaasenbeek, M., Angelo, M., Reich, M., Pinkus, G. S., Ray, T. S., Koval, M. A., Last, K. M., Norton, A., Lister, T. A., Mesirov, J., Neuberg, D. S., Lander, E. S., Aster, J. C., and Golub, T. R. Diffuse large B-cell lymphoma outcome prediction by gene expression profiling and supervised machine learning, Nat. Med. 8: 68-74, 2002.
2. Golub, T. R., Slonim, D. K., Tamayo, P., Huard, C., Gaasenbeek, M., Mesirov, J. P., Coller, H., Loh, M. L., Downing, J. R., Caligiuri, M. A., Bloomfield, C. D., and Landers, E. S. Molecular classification of cancer: class discovery and class prediction by gene expression monitoring, Science. 286: 531-537, 1999.

3. Perou, C. M., Sorlie, T., Eisen, M. B., van de Rijn, M., Jeffrey, S. S., Rees, C. A., Pollack, J. R., Ross, D. T., Johnsen, H., Akslen, L. A., Fluge, O., Pergamenschikov, A., Williams, C., Zhu, S. X., Lonning, P. E., Borresen-Dale, A.-L., Brown, P. O., and Botstein, D. Molecular portraits of human breast tumours, Nature. 406: 747-752, 2000.
4. Hedenfalk, I., Duggan, D., Chen, Y., Radmacher, M., Bittner, M., Simon, R., Meltzer, P., Gusterson, B., Esteller, M., Kallioniemi, O.-P., Wilfond, B., Borg, A., and Trent, J. Gene expression profiles in hereditary breast cancer, N. Engl. J. Med. 344: 539-548, 2001.
5. Khan, J., Wei, J. S., Ringner, M., Saal, L. H., Ladanyi, M., Westermann, F., Berthold, F., Schwab, M., Antonescu, C. R., Peterson, C., and Meltzer, P. S. Classification and diagnostic prediction of cancers using gene expression profiling and artificial neural networks, Nat. Med. 7: 673-679, 2001.
6. van 't Veer, L. J., Dai, H., van de Vijver, M. J., He, Y. D., Hart, A. A. M., Mao, M., Peterse, H. L., van der Kooy, K., Marton, M. J., Witteveen, A. T., Schreiber, G. J., Kerkhoven, R. M., Roberts, C., Linsley, P. S., Bernards, R., and Friend, S. Gene expression profiling predicts clinical outcome of breast cancer, Nature. 415: 530-536, 2002.
7. Gordon, G. J., Jensen, R. V., Hsiao, L.-L., Gullans, S. R., Blumenstock, J. E., Ramaswami, S., Richards, W. G., Sugarbaker, D. J., and Bueno, R. Translation of microarray data into clinically relevant cancer diagnostic tests using gene expression ratios in lung cancer and mesothelioma, Cancer Res. 62: TBD (Sept. 1 issue), 2002.
8. Jemal, A., Thomas, A., Murray, T., and Thun, M. Cancer statistics, 2002, CA Cancer. J. Clin. 52: 23-47, 2002.
9. Etzioni, R., Penson, D. F., Legler, J. M., Tommaso, D., Boer, R., Gann, P. H., and Feuer, E. J. Overdiagnosis due to prostate-specific antigen screening: Lessons from U.S. prostate cancer incidence trends, J. Natl. Cancer Inst. 94: 981-990, 2002.
10. Djavan, B., Zlotta, A., Kratzik, C., Remzi, M., Seitz, C., Schulman, C. C., and Marberger, M. PSA, PSA density, PSA density of transition zone, free/total PSA ratio, and PSA velocity for early detection of prostate cancer in men with serum PSA 2.5 to 4.0 ng/mL, Urology. 54: 517-522, 2001.
11. Pannek, J. and Partin, A. W. The role of PAS and percent free PSA for staging and prognosis prediction in clinically localized prostate cancer, Semin. Urol. Oncol. 16: 100-105, 1998.
12. Dhanasekaran, S. M., Barrette, T. R., Ghosh, D., Shah, R., Varambally, S., Kurachi, K., Pienta, K. J., Rubin, M. A., and Chinnaiyan, A. M. Delineation of prognostic biomarkers in prostate cancer, Nature. 412: 822-826, 2001.
13. Welsh, J. B., Sapinoso, L. M., Su, A. I., Kern, S. G., Wang-Rodriguez, J., Moskaluk, C. A., Frierson, H. F., and Hampton, G. M. Analysis of gene expression identifies candidate markers and pharmacological targets in prostate cancer, Cancer Res. 61: 5974-5978, 2001.
14. Venables, W. N. and Riley, B. D. Modem Applied Statistics with S-Plus. New York: Springer, 1997.

Example 5

Prediction of Outcomes of Lung Adenocarcinoma Using Expression Profiling Data

This example describes the use of published data relating gene expression profiles and outcome in lung adenocarcinoma. A set of gene ratios was generated by analyzing the data from Beer et al. (*Nature Med.* 8: 816-824, 2002), who used smaller chips (6800 genes), as a training set.

The training set ratios were tested using the published data set derived from expression profiling experiments using 12,000 genes (Bhattacharjee et al., *Proc. Natl. Acad. Sci. USA*. 98: 13790-13795, 2001). The object was to predict good outcome versus recurrence in stage I lung cancer after surgery. As shown below, the ratios derived from the training set data (Beer et al.) could differentiate significantly between good and poor outcomes in the test set data (Bhattacharjee et al.).

The analysis the other direction (using Bhattacharjee et al. expression data as the training set and Beer et al. expression data as the test set) did not work because the best genes in the analysis of the Bhattacharjee et al. expression data were not present in the genes (6800 gene chips) analyzed by Beer et al.

Gene selection criteria: Genes having a >2-fold higher expression in good or poor outcome samples, and the lowest (best) p values, were selected.

Training Set (Beer et al. data); good outcome (n=21) means alive at 5 years; poor outcome (n=11) means disease recurrence within 4 years.

TABLE 13

Genes overexpressed in tumors of different outcome

| Gene # | Overexpressed in ... | Locus Link Symbol | Accession # | Description |
|---|---|---|---|---|
| 1 | Good | APOE | M12529 | apolipoprotein E |
| 4 | Good | LPIN2 | D87436 | lipin 2 |
| 5 | Poor | SLC2A1 | K03195 | solute carrier family 2 (facilitated glucose transporter), member 1 |
| 6 | Poor | S100P | AA131149 | S100 calcium-binding protein P |
| 7 | Poor | MST1R | X70040 | macrophage stimulating 1 receptor (c-met-related tyrosine kinase) |

Gene ratios were calculated as follows:

$$\frac{\text{genes overexpressed in good outcome}}{\text{genes overexpressed in poor outcome}}$$

The application of the ratios is shown in Table 14.

TABLE 14

Training set gene ratios for predicting outcome

|  | error good | error poor | total error | % correct |
|---|---|---|---|---|
| 1/5 | 1 | 11 | 12 | 63 |
| 1/6 | 4 | 2 | 6 | 81 |
| 1/7 | 1 | 10 | 11 | 66 |
| 1/8 | 1 | 6 | 7 | 78 |
| 2/5 | 4 | 4 | 8 | 75 |
| 2/6 | 14 | 1 | 15 | 53 |
| 2/7 | 6 | 5 | 11 | 66 |
| 2/8 | 5 | 4 | 9 | 72 |
| 3/5 | 4 | 3 | 7 | 78 |
| 3/6 | 12 | 0 | 12 | 63 |
| 3/7 | 4 | 3 | 7 | 78 |
| 3/8 | 6 | 4 | 10 | 69 |
| 4/5 | 3 | 1 | 4 | 88 |

TABLE 14-continued

Training set gene ratios for predicting outcome

|  | error good | error poor | total error | % correct |
|---|---|---|---|---|
| 4/6 | 14 | 0 | 14 | 56 |
| 4/7 | 5 | 2 | 7 | 78 |
| 4/8 | 4 | 3 | 7 | 78 |
| 1/6, 4/5, 4/7 | 1 | 2 | 3 | 91 |

Error good = number of errors in predicting good outcome in training set
Error poor = number of errors in predicting poor outcome in training set
Error total = number of total errors in predicting outcome in training set The top 3 ratios from the training set (1/6, 4/5, 4/7) were chosen according to following criteria: poor>80% correctly identified and overall>75% correctly identified. The combination of these three ratios resulting in the prediction of 20/21 good outcome tumors and 9/11 poor outcome tumors (29/32=91%).

The three ratio combination was applied to the test set data of Bhattacharjee et al. The results are shown in Table 15:

TABLE 15

Application of gene expression ratios to test set
Test Set (Bhattacharjee et al. data); good outcome (n = 28) means alive at 5 years; poor outcome (n = 19) means disease recurrence within 4 years.

|  | error good | error poor | total | % correct | % correct poor |
|---|---|---|---|---|---|
| 1/6 4/5, 4/7 | 7 | 8 | 15 | 68 (32/47) | 58 (11/19) |

Error good = number of errors in predicting good outcome in test set
Error poor = number of errors in predicting poor outcome in test set
Error total = number of total errors in predicting outcome in test set

TABLE 16

Predictions and status for individual tumor samples
Stage 1 adenocarcinoma only; excluded patient tissue samples of <40% tumor cell and/or mixed histology.

|  | survival | status | Censor | % tumor | Group |
|---|---|---|---|---|---|
| Adeno31618Good | 60.5 | 1 | 0 | 50 | Good |
| Adeno31633Good | 83 | 1 | 0 | ? | Good |
| Adeno32004Good | 85.9 | 1 | 0 | 30 | Poor |
| Adeno32109Good | 99.1 | 1 | 0 | 80 | Good |
| Adeno32137Good | 98.9 | 1 | 0 | 60 | Poor |
| Adeno32019Good | 66.2 | 1 | 0 | 5 | Poor |
| Adeno32314Good | 62.6 | 1 | 0 | 40 | Good |
| Adeno32027Good | 71.1 | 1 | 0 | 70 | Good |
| Adeno32233Good | 72.4 | 1 | 0 | 80 | Poor |
| Adeno32244Good | 75.4 | 1 | 0 | 100 | Good |
| Adeno32618Good | 78.4 | 1 | 0 | 35 | Good |
| Adeno32605Good | 106 | 1 | 0 | 40 | Good |
| Adeno32713Good | 81.9 | 1 | 0 | ? | Good |
| Adeno32845Good | 76.6 | 1 | 0 | 25 | Poor |
| Adeno32744Good | 93.7 | 1 | 0 | 10 | Good |
| Adeno32731Good | 76 | 1 | 0 | 80 | Good |
| Adeno32708Good | 103 | 1 | 0 | 28 | Good |
| Adeno32140Good | 49 | 1 | 0 | 30 | Good |
| Adeno32034Good | 49.2 | 1 | 0 | 60 | Good |
| Adeno32633Good | 50.1 | 1 | 0 | 100 | Good |
| Adeno32318Good | 50.1 | 1 | 0 | 70 | Good |
| Adeno32103Good | 50.5 | 1 | 0 | 80 | Good |
| Adeno32846Good | 52.9 | 1 | 0 | 65 | Good |
| Adeno32212Good | 54.5 | 1 | 0 | 80 | Poor |
| Adeno32012Good | 56 | 1 | 0 | 95 | Good |
| Adeno32032Good | 56.3 | A | 0 | 90 | Good |
| Adeno32142Good | 56.7 | 1 | 0 | 80 | Good |
| Adeno31613Good | 57.6 | 1 | 0 | 80 | Good |
| Adeno32132Good | 58.5 | 1 | 0 | 90 | Poor |

TABLE 16-continued

Predictions and status for individual tumor samples
Stage 1 adenocarcinoma only; excluded patient tissue samples of <40% tumor cell and/or mixed histology.

|  | survival | status | Censor | % tumor | Group |
|---|---|---|---|---|---|
| Adeno32138Good | 59 | 1 | 0 | 80 | Good |
| Adeno32628Good | 59.3 | 1 | 0 | 30 | Good |
| Adeno32026Good | 66.8 | 4 | 0 | 90 | Good |
| Adeno32614Good | 76.1 | 2 | 0 | 80 | Poor |
| Adeno32706Good | 79 | 2 | 0 | 50 | Good |
| Adeno32031Good | 91 | 2 | 0 | 80 | Poor |
| Adeno32602Good | 71.5 | D | 1 | 100 | Poor |
| Adeno32013Poor | 41.9 | 3 | 1 | 60 | Good |
| Adeno32840Poor | 42.2 | 2 | 0 | 60 | Poor |
| Adeno32252Poor | 45.5 | 2 | 0 | 30 | Poor |
| Adeno32020Poor | 49.6 | 3 | 1 | 60 | Good |
| Adeno32254Poor | 47.2 | 3 | 1 | 60 | Poor |
| Adeno31635Poor | 48.3 | D | 1 | 30 | Good |
| Adeno32309Poor | 48.8 | D | 1 | 90 | Good |
| Adeno32634Poor | 40.5 | 2 | 0 | 90 | Good |
| Adeno31628Poor | 25.3 | 3 | 1 | 40 | Poor |
| Adeno31630Poor | 40.7 | 3 | 1 | 33 | Poor |
| Adeno32005Poor | 7.8 | 3 | 1 | 40 | Poor |
| Adeno32029Poor | 21.8 | 3 | 1 | 70 | Good |
| Adeno32030Poor | 16.5 | 3 | 1 | 60 | Poor |
| Adeno32211Poor | 14.2 | 3 | 1 | 70 | Poor |
| Adeno32248Poor | 8.8 | 3 | 1 | 80 | Poor |
| Adeno32312Poor | 41.2 | 3 | 1 | 80 | Poor |
| Adeno32313Poor | 23.4 | 3 | 1 | 70 | Good |
| Adeno32322Poor | 23.4 | 3 | 1 | 70 | Good |
| Adeno32613Poor | 7.3 | 3 | 1 | 80 | Poor |
| Adeno32735Poor | 20 | 3 | 1 | 70 | Poor |
| Adeno32739Poor | 38.9 | 3 | 1 | 30 | Poor |
| Adeno32746Poor | 8.2 | 3 | 1 | 40 | Poor |
| Adeno32748Poor | 37.6 | 3 | 1 | 95 | Good |
| Adeno32837Poor | 37.9 | 3 | 1 | 60 | Good |
| Adeno32848Poor | 10.5 | 3 | 1 | 30 | Good |

Figure 9:
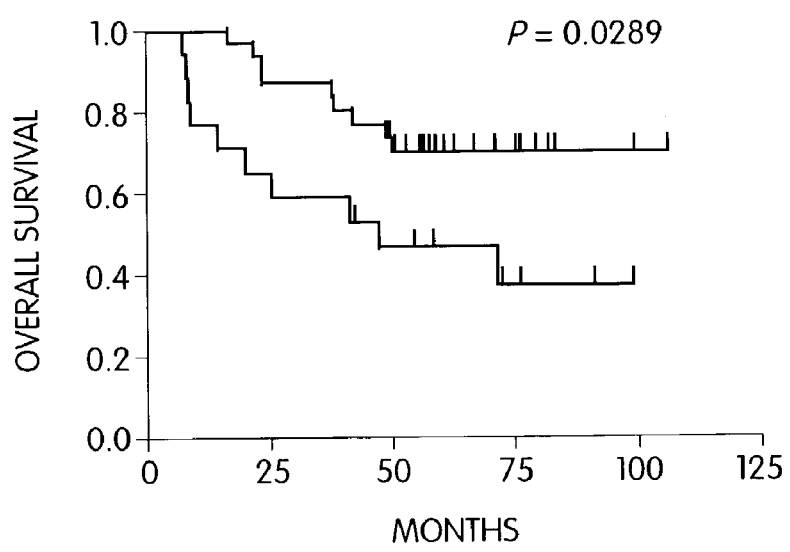
FIG. 9 shows Kaplan-Meier survival predictions of test set samples for adenocarcinoma patients as described in Example 5. Time to relapse for patients predicted to be good prognosis (top line) and poor prognosis (bottom line) using a 3-ratio model in the test set data of Bhattacharjee et al. Hash marks indicate censored data.

Survival: in months
Status: 1 = alive without disease; 2 = alive with disease; 3 = dead from disease; 4 = dead from other causes; A = alive, disease status unknown; D = dead, reason unknown.
Censor: for Kaplan-Meier analysis (see FIG. 9); 0 = no censoring event; 1 = presence of censoring event
% tumor: in sample on slide
Group: good or poor outcome as predicted by gene ratios

Example 6

Analysis of Gene Expression Data in Various Cancers for Diagnosis and Prognosis This example represents analyses of gene expression profiling data presented in the literature for several different types of cancer. Each chart has several lists of genes that are increased in expression or decreased in expression in a given diagnosis or prognosis.

The method applied to the analyses of the data uses a combination of ratios of genes from one set always in the numerator and a second set always in the denominator to determine diagnosis or prognosis. The genes used in the ratios for determination of diagnosis or prognosis are numbered.

A. Rosenwald et al. (N Engl J Med 346(25):1937-1947, 2002), Diagnosis of subtype germinal-center B-cell-like (GCB) vs type III in diffuse large B-cell lymphoma (DL-BCL). Genes having a >2-fold higher expression in different diagnosis samples, and the lowest (best) p values, are shown in Table 17.

Training set=109 samples, Test set=58 samples

TABLE 17

Genes overexpressed in germinal-center B-cell-like (GCB) or type III in diffuse large B-cell lymphoma (DLBCL)

| | Uniquid | Genes | Accession # |
|---|---|---|---|
| | overexpressed in GCB | | |
| 1 | 24991 | | ~AA825906 |
| 2 | 24376 | ESTs, Weakly similar to A47224 thyroxine-binding globulin precursor | Hs.317970 |
| 3 | 19384 | MAPK10: mitogen-activated protein kinase 10 | Hs.151051 |
| 4 | 15914 | MAPK10: mitogen-activated protein kinase 10 | Hs.151051 |
| | 29912 | ESTs, Weakly similar to neuronal thread protein [*Homo sapiens*] [*H. sapiens*] | Hs.104425 |
| | 20198 | FEM1B: fem-1 homolog b (C. elegans) | AF178632 |
| | 29967 | *Homo sapiens* cDNA FLJ11170 fis, clone PLACE1007301 | AK002032 |
| | 24971 | KIAA0807 protein | AB018350 |
| | 28472 | MAPK10: mitogen-activated protein kinase 10 | U07620 |
| | 25069 | OSBPL3: oxysterol binding protein-like 3 | AB014604 |
| | overexpressed in Type III | | |
| 5 | 30880 | EST | Hs.275766 |
| 6 | 27783 | LY6E: lymphocyte antigen 6 complex, locus E | Hs.77667 |
| 7 | 16430 | PML: promyelocytic leukemia | Hs.89633 |
| 8 | 25001 | FLT3LG: fms-related tyrosine kinase 3 ligand | Hs.428 |
| | 34166 | CLCN7: chloride channel 7 | Hs.80768 |
| | 32671 | ZAP70: zeta-chain (TCR) associated protein kinase (70 kD) | L05148 |
| | 25196 | TRG@: T cell receptor gamma locus | M30894 |
| | 27460 | | LC__27460 |
| | 32673 | CD6: CD6 antigen | X60992 |
| | 27147 | PTPN13: protein tyrosine phosphatase, non-receptor type 13 (APO-1/CD95 (Fas)-associated phosphatase) | D21210 |

B. Welsh et al. (Proc Natl Acad Sci USA 98(3):1176-1181, 2001), Analysis of gene expression profiles in normal and neoplastic ovarian tissue samples identifies candidate molecular markers of epithelial ovarian cancer. Genes having a >2-fold higher expression in ovarian tumor or normal samples, and the lowest (best) p values, are shown in Table 18.

Training set=22 samples, Test set=12 samples

TABLE 18

Genes overexpressed in tumor or normal ovarian epithelium

| | Probe ID | Gene |
|---|---|---|
| | Overexpressed in Tumor | |
| 1 | X12876_s_at | KRT18: keratin 18 |
| 2 | HG110-HT110_s_at | HNRPAB: heterogeneous nuclear ribo-nucleoprotein A/B |
| 3 | Y00503_at | KRT19: keratin 19 |
| 4 | M93036_at | TACSTD1: tumor-associated calcium signal transducer 1 |
| | X74929_s_at | KRT8: keratin 8 |
| | HG2815-HT2931_at | MYL6: myosin, light polypeptide 6, alkali, smooth muscle and non-muscle |

TABLE 18-continued

Genes overexpressed in tumor or normal ovarian epithelium

| | Probe ID | Gene |
|---|---|---|
| | J02783_at | P4HB: procollagen-proline, 2-oxoglutarate 4-dioxygenase (proline 4-hydroxylase), beta polypeptide (protein disulfide isomerase; thyroid hormone binding protein p55) |
| | X17567_s_at | SNRPB: small nuclear ribonucleoprotein polypeptides B and B1 |
| | L19686_rna1_at | MIF: macrophage migration inhibitory factor (glycosylation-inhibiting factor) |
| | X69699_at | PAX8: paired box gene 8 |
| | Overexpressed in Normal | |
| 5 | U24488_s_at | TNXB: tenascin XB |
| 6 | D26155_s_at | SMARCA2: SWI/SNF related, matrix associated, actin dependent regulator of chromatin, subfamily a, member 2 |
| 7 | U17280_at | STAR: steroidogenic acute regulatory protein |
| 8 | X86401_s_at | GATM: glycine amidinotransferase (L-arginine:glycine amidinotransferase) |
| | X63741_s_at | EGR3: early growth response 3 |
| | U90336_s_at | PEG3: paternally expressed 3 |
| | M21574_at | PDGFRA: platelet-derived growth factor receptor, alpha polypeptide |
| | Z26653_at | LAMA2: laminin, alpha 2 (merosin, congenital muscular dystrophy) |
| | U36922_at | FOXO1A: forkhead box O1A (rhabdomyosarcoma) |
| | M97796_s_at | ID2: inhibitor of DNA binding 2, dominant negative helix-loop-helix protein |

C. Rosenwald et al. (N Engl J Med 346(25):1937-1947, 2002), Diagnosis of subtypes germinal-center B-cell-like (GBC) vs activated B-cell-like (ABC) in diffuse large-B-cell lymphoma (DLBCL). Genes having a >2-fold higher expression in different diagnosis samples, and the lowest (best) p values, are shown in Table 19.

Training set=129 samples, test set=59 samples

TABLE 19

Genes overexpressed in germinal-center B-cell-like (GBC) or activated B-cell-like (ABC) in diffuse large-B-cell lymphoma (DLBCL)

| | Probe ID | Gene | Accession # |
|---|---|---|---|
| | Over-expressed in GBC | | |
| 1 | 24376 | ESTs, Weakly similar to A47224 thyroxine-binding globulin precursor | Hs.317970 |
| 2 | 24480 | | LC__24480 |
| 3 | 19384 | MAPK10: mitogen-activated protein kinase 10 | Hs.151051 |
| 4 | 15914 | MAPK10: mitogen-activated protein kinase 10 | Hs.151051 |
| | 24991 | | AA825906 |
| | 25126 | | LC__25126 |
| | 34694 | DKFZP434M098 protein | AL117587 |
| | 19202 | STAG3: stromal antigen 3 | AJ007798 |
| | 24825 | HDAC1: histone deacetylase 1 | D50405 |
| | 26725 | EBF: early B-cell factor | AF208502 |
| | Over-expressed in ABC | | |
| 5 | 19375 | DDB1: damage-specific DNA binding protein 1 (127kD) | Hs.108327 |
| 6 | 19346 | SH3BP5: SH3-domain binding protein 5 (BTK-associated) | Hs.109150 |

TABLE 19-continued

Genes overexpressed in germinal-center B-cell-like (GBC) or activated B-cell-like (ABC) in diffuse large-B-cell lymphoma (DLBCL)

| | Probe ID | Gene | Accession # |
|---|---|---|---|
| 7 | 22118 | | LC__22118 |
| 8 | 27565 | ENTPD1: ectonucleoside triphosphate diphosphohydrolase 1 | Hs.205353 |
| | 33991 | FOXP1: forkhead box P1 | AF146696 |
| | 26454 | SH3BP5: SH3-domain binding protein 5 (BTK-associated) | AB005047 |
| | 16614 | IRF4: interferon regulatory factor 4 | U52682 |
| | 28536 | ENTPD1: ectonucleoside triphosphate diphosphohydrolase 1 | S73813 |
| | 31104 | | LC__31104 |
| | 33109 | BLNK: B-cell linker | AF068180 |
| | 31801 | BMF: Bcl-2 modifying factor | NM__033503 |

D. Shipp et al (Nat Med 8(1):68-74, 2002), Diagnosis of diffuse large B-cell lymphoma (DLBCL) vs. follicular lymphoma (FL). Genes having a >2-fold higher expression in different diagnosis samples, and the lowest (best) p values, are shown in Table 20.

Training set=39 samples, Test set=38 samples

TABLE 20

Genes overexpressed in diffuse large B-cell lymphoma (DLBCL) or follicular lymphoma (FL)

| | Accession # | Gene |
|---|---|---|
| | Overexpressed in DLBCL | |
| 1 | D43950__at | CCT5: chaperonin containing TCP1, subunit 5 (epsilon) |
| 2 | U28386__at | KPNA2: karyopherin alpha 2 (RAG cohort 1, importin alpha 1) |
| 3 | U63743__at | KNSL6: kinesin-like 6 (mitotic centromere-associated kinesin) |
| 4 | X65867__at | ADSL: adenylosuccinate lyase |
| | M22960__at | PPGB: protective protein for beta-galactosidase (galactosialidosis) |
| | J02783__at | P4HB: procollagen-proline, 2-oxoglutarate 4-dioxygenase (proline 4-hydroxylase), beta polypeptide (protein disulfide isomerase; thyroid hormone binding protein p55) |
| | X62078__at | GM2A: GM2 ganglioside activator protein |
| | M34079__at | PSMC3: proteasome (prosome, macro-pain) 26S subunit, ATPase, 3 |
| | J02645__at | EIF2S1: eukaryotic translation initiation factor 2, subunit 1 (alpha, 35kD) |
| | U23143__at | SHMT2: serine hydroxymethyltransferase 2 (mitochondrial) |
| | Overexpressed in FL | |
| 5 | AB002409__at | SCYA21: small inducible cytokine sub-family A (Cys-Cys), member 21 |
| 6 | D87119__at | gene with protein product, function unknown |
| 7 | Z11793__at | SEPP1: selenoprotein P, plasma, 1 |
| 8 | HG3928-HT4198__at | SFTPA2: surfactant, pulmonary-associated protein A2 |
| | X91911__s__at | RTVP1: glioma pathogenesis-related protein |
| | D50683__at | TGFBR2: transforming growth factor, beta receptor II (70-80 kD) |
| | K02777__s__at | TRA@: T cell receptor alpha locus |
| | M18255__cds2__s__at | *Homo sapiens* cDNA FLJ32993 fis, clone THYMU1000103, weakly similar to PROTEIN KINASE C, BETA-I TYPE (EC 2.7.1.-) |

TABLE 20-continued

Genes overexpressed in diffuse large B-cell lymphoma (DLBCL) or follicular lymphoma (FL)

| Accession # | Gene |
|---|---|
| M12963__s__at | ADH1A: alcohol dehydrogenase 1A (class I), alpha polypeptide |
| HG2239-HT2324__r__at | KCNC3: potassium voltage-gated channel, Shaw related subfamily, member 3 |
| D45370__at | APM2: adipose specific 2 |

E. Rosenwald et al. (N Engl J Med 346(25):1937-1947, 2002), Diagnosis of subtype activated B-cell-like (ABC) vs type III diffuse large-B-cell lymphoma. Genes having a >2-fold higher expression in different diagnosis samples, and the lowest (best) p values, are shown in Table 21.

Training set=82 samples, test set=43 samples

TABLE 21

Genes overexpressed in subtype activated B-cell-like (ABC) or type III diffuse large-B-cell lymphoma

| | Probe ID | Gene | Accession # |
|---|---|---|---|
| | | Overexpressed in ABC | |
| 1 | 22122 | IRF4: interferon regulatory factor 4 | Hs.82132 |
| 2 | 33991 | FOXP1: forkhead box P1 | Hs.274344 |
| 3 | 24899 | PIM1: pim-1 oncogene | Hs.81170 |
| 4 | 24416 | PIM1: pim-1 oncogene | Hs.81170 |
| | 24729 | IRF4: interferon regulatory factor 4 | U52682 |
| | 16614 | IRF4: interferon regulatory factor 4 | U52682 |
| | 24701 | ZNFN1A1: zinc finger protein, subfamily 1A, 1 (Ikaros) | U40462 |
| | 26516 | ESTs, Weakly similar to HERV-E envelope glycoprotein [*H. sapiens*] | Hs.370685 |
| | 19348 | ESTs, Weakly similar to HERV-E envelope glycoprotein [*H. sapiens*] | Hs.370685 |
| | 19375 | DDB1: damage-specific DNA binding protein 1 (127kD) | U32986 |
| | | overexpressed in Type III | |
| 5 | 28060 | EPHB6: EphB6 | Hs.3796 |
| 6 | 17533 | EPHB6: EphB6 | Hs.3796 |
| 7 | 29998 | CCND1: cyclin D1 (PRAD1: parathyroid adenomatosis 1) | Hs.82932 |
| 8 | 27147 | PTPN13: protein tyrosine phosphatase, non-receptor type 13 (APO-1/CD95 (Fas)-associated phosphatase) | Hs.211595 |
| | 27974 | IGF1: insulin-like growth factor 1 (somatomedin C) | X57025 |
| | 27857 | CST3: cystatin C (amyloid angiopathy and cerebral hemorrhage) | X05607 |
| | 29780 | | LC__29780 |
| | 28766 | PTPRM: protein tyrosine phosphatase, receptor type, M | X58288 |
| | 15930 | CHL1: cell adhesion molecule with homology to L1CAM (close homolog of L1) | AF002246 |
| | 27460 | | LC__27460 |
| | 34166 | CLCN7: chloride channel 7 | Hs.80768 |

F. Shipp et al (Nat Med. 8(1):68-74, 2002), Prognosis of diffuse large B-cell lymphoma (DLBCL). Good prognosis was defined by Shipp as no disease recurrance; bad prognosis was defined by Shipp as recurrance of disease. Genes having a >2-fold higher expression in good or poor prognosis samples, and the lowest (best) p values, are shown in Table 22.

Training set, n=29; Test set, n=29

TABLE 22

Genes overexpressed in diffuse large B-cell lymphoma (DLBCL) of good and poor outcome

| | Accession # | Gene |
|---|---|---|
| | | Overexpressed in Good |
| 1 | L05512_at | HTN1: histatin 1 |
| 2 | U73328_at | DLX4: distal-less homeobox 4 |
| 3 | Y13247_at | PPP1R10: protein phosphatase 1, regulatory subunit 10 |
| 4 | M29277_at | MCAM: melanoma cell adhesion molecule |
| | | Overexpressed in Poor |
| 5 | D86969_at | KIAA0215 gene product |
| 6 | L20971_at | PDE4B: phosphodiesterase 4B, cAMP-specific (phosphodiesterase E4 dunce homolog, Drosophila) |
| 7 | M18255_cds2_s_at | *Homo sapiens* cDNA FLJ32993 fis, clone THYMU1000103, weakly similar to PROTEIN KINASE C, BETA-I TYPE (EC 2.7.1.-) |
| 8 | HG4322-HT4592_at | TUBB: tubulin, beta polypeptide |

Example 7

Prognosis of Lung Adenocarcinoma

Data from Bhattacharjee et al. for Stage 1 lung cancer was used as in Example 5, except that: 1) only samples with >50% tumor were used, and 2) a 5 year survival cutoff was used instead of 4 year survival. Thus the criteria for prognosis were: good=alive, survival >60 mos; poor=dead, survival <60 mos. This reduced the sample numbers to: n=12 for good prognosis, n=17 poor prognosis. Genes having a >2-fold higher expression in good or poor prognosis samples, and the lowest (best) p values, are shown in Table 23.

TABLE 23

Genes overexpressed in good or poor outcome

| Over-expressed in . . . | Locus Link Symbol | Accession # | Description |
|---|---|---|---|
| Good | FOLR1 | U78793 | folate receptor 1 (adult) |
| Good | DUSP6 | AB013382 | dual specificity phosphatase 6 |
| Good | SEPP1 | Z11793 | selenoprotein P, plasma, 1 |
| Good | LTF | U95626 | lactotransferrin |
| Good | KIAA0758 | AB018301 | KIAA0758 protein |
| Poor | MMP9 | J05070 | matrix metalloproteinase 9 (gelatinase B, 92kD gelatinase, 92kD type IV collagenase) |
| Poor | IGFBP3 | M35878 | insulin-like growth factor binding protein 3 |
| Poor | FN1 | None (TIGR seq.) | Fibronectin, Alt. Splice 1 311_s_at |
| Poor | UBCH1O | U73379 | ubiquitin-conjugating enzyme E2C |
| Poor | UBD | AL031983 | diubiquitin |

The present invention is not limited in scope by the examples provided, since the examples are intended as illustrations of various aspects of the invention and other functionally equivalent embodiments are within the scope of the invention. Various modifications of the invention in addition to those shown are described herein will become apparent to those skilled in the art for the foregoing description and fall within the scope of the appended claims. The advantages and objects of the invention are not necessarily encompassed by each embodiment of the invention.

All references, patents, and patent publications that are recited in this application are incorporated in their entirety herein by reference.

SEQUENCE LISTING (102 sequences)

SEQ ID NO: 1 - DNA, 20 bp, Homo sapiens
gccatgacaatggtgtgaac

SEQ ID NO: 2 - DNA, 20 bp, Homo sapiens
gcaaatggcaccgagatatt

SEQ ID NO: 3 - DNA, 20 bp, Homo sapiens
aggactctggggtcatcaag

SEQ ID NO: 4 - DNA, 20 bp, Homo sapiens
agttgggatctccacggtag

SEQ ID NO: 5 - DNA, 20 bp, Homo sapiens
tgaggcttcctccaactacc

SEQ ID NO: 6 - DNA, 20 bp, Homo sapiens
tgcctttcttatccccattc

SEQ ID NO: 7 - DNA, 20 bp, Homo sapiens
aacccagaggcattgacaac

SEQ ID NO: 8 - DNA, 20 bp, Homo sapiens
acttccagctccttgacgtt

SEQ ID NO: 9 - DNA, 2026 bp, Homo sapiens
gaattccggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcacctcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagattttgattgaaagtcctagggtgattctatttctgctgtgatttatctgctgaaagctcagctggggttgtgcaagctagggacccattcctgtgtaatacaatgtctgcaccaatgctaataaagtcctattctcttttaaaaaaaaaaaaaaaaaaaaaacggaattc

SEQ ID NO: 10 - protein, 381 aa, Homo sapiens
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 11 - DNA, 672 bp, Homo sapiens
aatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgaga

SEQ ID NO: 12 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 13 - DNA, 1207 bp, Homo sapiens
tccagttaggagccttgatgccggaggggacagtgggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctcccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccgcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtcttgccgccttggtagcttgctcctggtatggccatcagattgtcacagacttttataaccctttgatccctaccaacattaagtatgagtttggccctgccatctttattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagc

SEQ ID NO: 14 - protein, 211 aa, Homo sapiens
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRAPRSYPKSNSSKEYV

SEQ ID NO: 15 - DNA, 1426 bp, Homo sapiens
cggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 16 - protein, 271 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEINIQQLTNYRKSVMSLAEAGKLYRKDLEIVLCSEPPM

SEQ ID NO: 17 - DNA, 1940 bp, Homo sapiens
aggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 18 - protein, 327 aa, Homo sapiens
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 19 - DNA, 2529 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatcacagagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 20 - protein, 590 aa, Homo sapiens
MSRQSSVSFRSGGSRSFSTASAITPSVSRTSFTSVSRSGGGGGGGFGRVSLAGACGVGGYGSRSLYNLGGSKRISISTRGGSFRNRFGAGAGGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEITEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 21 - DNA, 1582 bp, Homo sapiens
cagagcggagacttcagggagaccagagcccagttgcaggcactcagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtaatcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttgaccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcactactggctgggctgcccagctcctggccatctgtaggagtcagagcccacatggccgggccctctgtagctccctcctcccatctccttcccccagcccaataaaggtcccttagccccg

SEQ ID NO: 22 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGNQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLTKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAHYWLGCPAPGHL

SEQ ID NO: 23 - DNA, 817 bp, Homo sapiens
agtcctgcgtccgggccccgaggcgcagcagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaa

SEQ ID NO: 24 - protein, 174 aa, Homo sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 25 - DNA, 2202 bp, Homo sapiens
gaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgccggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggttttttttttaaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctggggacactctgccagcaaagaggactcgcttgtaaataccaggattttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaaaaaaaaaaaaaaaaaaaaaaaaaaaaaaaaa

SEQ ID NO: 26 - protein, 401 aa, Homo sapiens
MWSGGSGKARGWEAAAGGRSSPGRLSRRRIMSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 27 - DNA, 2533 bp, Homo sapiens
ggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccattcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 28 - protein, 43 aa, Homo sapiens
MLTNVFISVVLFPCSNLTKPTVLVLYCPGGAITVLVEWCCFNS

SEQ ID NO: 29 - DNA, 531 bp, Homo sapiens
  misc_feature (153)..(153): n = a, c, g or t
  misc_feature (335)..(335): n = a, c, g or t
  misc_feature (408)..(408): n = a, c, g or t
  misc_feature (416)..(416): n = a, c, g or t
  misc_feature (498)..(498): n = a, c, g or t
gcaaggctggtgggcgtggactcaaagcatggcagcggcagaggctggagcagttggggatcttcagcttctaaatgctaattacacagtgagctttgggctattttttccatgagcttaatgatgctttctctgggcttttgggggagggtntccaccagcttcttcagctgagcccctgcctccctcatgtcttgatcagggctgaaaagttccatggcagcctcataactggagggtgtgtccatgaggagggtttcgatgacacgctgaaagctcgggcagatctctgcaggaagcggactgccagcagagagccagtgtgaccaggggtnaggggtgacagcgagttttcatgggtggaaggagggggatgctcttgcccttcttcgttccccaatttccctncaaccccnggggatcccacttagtttcttaagaagccgccccccaacccggttgggaacttcccactttttttttcccctttaagttaanggttaatttttcgagctttggcgtaaatcaatg

SEQ ID NO: 30 - protein, 91 aa, Homo sapiens
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 31 - DNA, 609 bp, Homo sapiens
ttttttttttttgataaagactttttatgccaggaatggattaattaccaacaaaatttatactaatcaggctgatgtcaatctatttttgtaatgtatcattaacaaatttattttggaaaagataaaaatattgccccttgataataaatctttttttcctttgatgcaaacagctagaacacctttttctttttctttttgatattctaagacaaaaaaatggttaatcttcagattaataaattaggtcattataataataaattaattttttttaaagttcagcaacctctgtccaagtatttacaacaatacttgaaagttcctttacaaaacagaacacattttcttttcacgttaagcatactgggtatctgtgtctttcacaacaagcatttttaaaagaaaactcaatgcacaaatgggttaattagtataaaagtgctaagggctgtttgaaaagttaccactatagtatacagtcagttatatttgaggcatactacaacaaacttccagcttattgtggacaatattccagtagttgtttcaaaccattgtttgaaaaaaaaaaaaaaaaaatccaggagctgattagtgatgcag

SEQ ID NO: 32 - protein, 1036 aa, Homo sapiens
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 33 - DNA, 6720 bp, Homo sapiens
  misc_feature (834)..(834): n = a, c, g or t
  misc_feature (4905)..(4905): n = a, c, g or t
  misc_feature (5789)..(5789): n = a, c, g or t
  misc_feature (5986)..(5986): n = a, c, g or t
  misc_feature (6485)..(6485): n = a, c, g or t
ctctctgcagatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggscttatccagttcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtnacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgsctcctggrcctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggtcgggagttcaagaccagcctggccaacatggcgaaaccccgtctctactaaacataaaaaaattagtcaggtgtggcggtgccgtgcctgtaatcccagctattcaggaggctgaggcaccagaattgcttgaacccaggaggtggaggttgcagtgaactgaagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataarctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcacctccttggaaccacagtcattagtgaattacactcaaggaaaagatgtgctcccaccaggcagctccagctgttacctgagatactgaagtgcagctcaggagacgattatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactctttttttttttttttttttgagatggagtctcgctctgctgcccaggctagagtgcagtggcgtgatctcggctcactgcaagctctgcctcccgtgttcacaccattctcctgcctcagcctcctgagtagctgggactacaggcacccgccaccacacccggctaatttttggatttttagtagagatgggatttcaccgtattagccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttttgagacggagtttcacgcttattgcccaggctggagtgcaatggcacgatctcagctcaccacaacctccacctcctgggtttaagcaatgcttctgcctcagcttcccaagtagctgagattacaggcgcacaccaccacggccaactggtttttgtatttttagtagagacggggttcccccatgttggtcaggctggtctcgaaactcctgaccctcgtgatttgcctgcctggggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtrttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttaatgattaaaaagaataaacacagtgtttcctgagtagcagtgattgttatgccttgctattttaataaagattctattttcgtataacattgtcaagtggaaacatgctgaaatctattaaaccatctttgtttgtggaactgcctctgagtgtgattctgatggagggcattggccgtgcctggaatggtgaggtcagctcttgggacaggagagcacagagcatctactctgtcccttgctgtgggcccaggcctctcacagacagaactgagtcacacctttacccaccctccaaggcatagatgagtatccccgtttttacagagaaagaaactgagggtcagagaggtgaagtggtttgcccaagaacgtgtggctaagaggtaatagacctggaattcaaatgcaggaccctctgctgcctgagacagtgttcaggatctttctttcagtgatcctccggctggcagcagagggactgggtacccattagagcaggggtccacaacccctgggccacggatcagtataggtccttggcctattaagaaatgggctgcacaacaggaggtgaatggcgagtgagttagcaaagcttcatctacatttacagccactccccatcactcacattactgcctgagctccacctcctgtcagatcagtggcaccattagattctcataggagggcgaaccctattgtgaactgcacaggcgaggaatctaggtttcgcactccttatgagaatctaatgcctggtcatctatcactgtctcccatcacccccagatgggaccatctagctgaaggaaaacaagctcagggctcccwntgattctacattatggtgagttgtataattawctcactatttcaaacaatgtaataataatataaataaagtgcacaataaacgtaatgcacttgaaccatcctgaaaccatacctcccacccccacccctgggtcgctggaagaattgtcttctatgaaatcagtccctggtgccaaaaaggttggggactgccgcattagaggactttggggtagaccctggtaacaagcagacaacacaaaagctctctttaaaattcaccggatgctgtccatccttcaccagaatgcatgcattcatgttaaaataaaaaagaaggggtgaaatggattaaataagccttgggagaaataaaaagagaaatttggttttttctctcaaatctttgtatagaaataatatcccagggcagatgtgcctcacgtcagtttcctcatctgtgaggaggtcatggaggcacaacaggtgggatggggatttggcagtgagtgaaagacttccaaagtaacatagcaacatgttatatattaacatgctttcaatcaataccacaggtttttttttttttttttttttgagatggagtcttgctctgtctcccaggctggagtgcagtggtgagatctcagctcactgcaacctccgcctcccggattcaagggattctcctacctcagcctcctgagtagctgggattatgggcatgtgccactacacccagctaawttttgtatttttagtagagacggggtttcaccatgttggccaggctggtcttgaattcctgacctcaggtgatctgcccacctcggcctcccaaagtgctgggattacaggcatgagccaccatgcatggccacattttttttttctctttcaagnagatacgggaggccagaggtggtgtgacatctccacaatcatgaggttccctcctttctggaccctctagcatctgtaaccagtggtttccacctcaggggccgttatggctgcttaagctccagccattttgtccacattccacccagcaggaaagagggtgaagcaaagragagraaaacccctgcattcatccnattggtcagaamtcaatcacatgaccacagcttgctggacaracaggaggctgggaaatgtagtctttctcttcaggacatcagtatgtgccctcagaggggtaccataccccagtttgagaagtgctgcgttatgctctcttgtttaccagtcatggtctgaaccacatggcagggccagagggacagggcttggcttccctgagccgctgacctagcctttgttataacccrggtcctagtgatctgcagctcmaagactttggcctttcatacccttgtaccattaaagtcaacagaaagacccagtgttttattttgccaggtaaggacattaagaaatacatttactcctactgtcagcttatgaaaggatattttaatacccctaaagcagaaaggtaggttttatattggaattaacacaaccactcactcaaaagtctatattgaatagcccmaaaggtggaaacamwccagatgycccccacctgataangggataagccaawtgtgatgtacccccatyccaagggaataatatttgtcaataaaaaggaatcaagtactgacatatgctacaacacaaatgagccttgaaaatattatgctaagaggaaaaagccagtyacmaaaggccacttattataggactgratgtacatgraatgtccagrataggsaaatctatagagacatgragttggctagtggtttccagggatggtcgaggc

SEQ ID NO: 34 - protein, 500 aa, Homo sapiens [sequence omitted]

SEQ ID NO: 35 - DNA, 2442 bp, Homo sapiens
gcgggattccgggccgggccggcctgggctgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 36 - protein, 517 aa, Homo sapiens
MAVSRKDWSALSSLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWPLEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 37 - DNA, 2116 bp, Homo sapiens
cggttctccaagcacccagcatcctgctagacgcgccgcgcaccgacggaggggacatgggcagagcaatggtggccaggctggggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatgaatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcattggttcattaattctataaggccataaaacaggtaatataaaaagcttccatcgatctatttatatgtacatgagaaggaatccccaggtgttactgtaattcctcaacgtattgtttcgacggcactaatttaatgccgatatactctagatgaatgtttacattgttgagctattgctgttctcttgggaactgaactcactttcctcctgaggctttggatttgacattgcatttgaccttttaggtagtaattgacatgtgccagggcaatgatgaatgagaatctaccccagatccaagcatcctgagcaactcttgattatccatattgagtcaaatggtaggcatttcctatcacctgtttccattcaacaagagcactacattcttttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttagaactcctgacctcaggtgatccacccgcctcggcctcccaaagtgctgggattacaggcttgagcccccgcgcccagccatcaaaatgctttttatttctgcatatgtttgaatactttttacaatttaaaaaaatgatctgttttgaaggcaaaattgcaaatcttgaaattaagaaggcaaaatgtaaaggagtcaaactataaatcaagtatttgggaagtgaagactggaagctaatttgcataaattcacaaacttttatactctttctgtatatacattttttttctttaaaaaacaactatggatcagaatagcaacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgtttgtatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtggttgtgtatttacgctttgattcatagtaacttcttatggaattgatttgcattgaacgacaaactgtaaataaaaagaaacggtg

SEQ ID NO: 38 - protein, 80 aa, Homo sapiens
MGRAMVARLGLGLLLLALLLPTQIYSSETTTGTSSNSSQSTSNSGLAPNPTNATTKAAGGALQSTASLFVVSLSLLHLYS

SEQ ID NO: 39 - DNA, 455 bp, Homo sapiens
tttattatcaacagacaaaaaaagtttattgaatacaaaactcaaaggcatcaacagtcctgggcccaagagatccatggcaggaagtcaagagttctgcttcagggtcggtctgggcagccctggaagaagtcattgcacatgacagtgatgagtgccaggaaaacagcatactcctggaagtccacctgctggtcactgttctcatccaggctgcccatcagcttcttcagcccctcctcatccactttctcccccacaaagctgggcagctccttgtgcagaagttccttcatttcccccttactcagcttgaacttgtcgccctcttggcaggagtacttgtggaaggtagtgaccagcacagccagcgcctgctccagagaactgcacatcatggatctgtggctgtgtacttgttttctctcagcctcacccccacatggtgagctcac

SEQ ID NO: 40 - protein, 97 aa, Homo sapiens
MCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 41 - DNA, 1340 bp, Homo sapiens
gggtacggctgcgagaagacgacagaagggtacggctgcgagaagacgacagaaggggtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaacagtaaacacccttttgaaaccaaaaaaaaaaaaaaaaaa

SEQ ID NO: 42 - protein, 460 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 43 - DNA, 2388 bp, Homo sapiens
tcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 44 - protein, 764 aa, Homo sapiens
MGSNLSPQLCLMPFILGLLSGGVTTTPWSLAQPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 45 - DNA, 1083 bp, Homo sapiens
atcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcccttgggcttccaggtgtggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactctggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggcgctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggcggcccccatcacctctactgtctcctccctgggctaagcaggggagaagcgggctgggggtagcctggatgtgggcgaagtccactgtcctccttggcggcaaaagcccattgaagaagaaccagcccagcctgccccctatcttgtacctggaatatttttggggttggaactc

SEQ ID NO: 46 - protein, 201 aa, Homo sapiens
MANKGPSYGMSREVQSKIEKKYDEELEERLVEWIIVQCGPDVGRPDRGPLGFQVWLKNGVILSKLVNSLYPDGSKPVKVPENPPSMVFKQMEQVAQFLKAAEDSGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 47 - DNA, 1600 bp, Homo sapiens
gccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 48 - protein, 482 aa, Homo sapiens
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 49 - DNA, 4039 bp, Homo sapiens
  misc_feature (219)..(219): n = a, c, g or t
  misc_feature (3032)..(3032): n = a, c, g or t
  misc_feature (3043)..(3043): n = a, c, g or t
ctgcaggtagggccctcccaccccttcgccgcgccttacgaggcaagtctcccgcccttctctcagccaacatagaaaagcagcggagttcattctgctgtccggttgctgcacgggctccagcgcttcgcaactttggtttttttccacagatccagtggggtccggacatgggccccgcaggcgaaacgaacgttccagccaccaggaggccacctnattgtttcaaaaataaagactggttcctctcttggtttcagactgctatttttttcatggttggggatcagcgggagacggggaggtgctaggaggagagggcgggaaaagagggctctctcctcttccaatcctctgatcttcctgtgttgggagggtcagattactgtgccccagcccacgtccccccacgacccccgcacccccacctccccccacgaccccccccacctccgagcgggttctgtgcccaggtggcgctggagaaaggaacagcggaccccgcccaagtcattactaatgtagcaatcgtcttgcataaacccaggccacggttcctattggctgaagtcctctgaggtgacgtcatcgggacgtactaagactagggttgggccgagagtcggagccattactgcaggaaaaggtcccggagagctgagcagtcaagatggtggggcccaggtcttgggagacgggcaggattggggacgagaggcaggaagagacgggtcggggggcgaggagaaggcaggggtaggaggcaaagggaatctgaggacccgaaagttggaggtggggttggaaagactggggccctgcggggcaagcgagtctgcagcctgaaacaggagctttgtgggtcagagtttgtgggtcagagtttgtggggctgggatagaaactgggggattggcgttcagatgctgaccacttccctcttctctgagcagtgtgacttcaccgaagaccagaccgcaggtaggttatctctgatccctaccgaggtccacccttagggagagggacaccctccccccagcacctatcctctaatcttaatctgtcatctctttagcacccccatgagattaccccctggattattttctcttcttctggatcctccattttcttttctcactttcttcctccctccccttccactctagatctgatcccaagcactgggtgagttttaggtggtgtgggtatgaaaaaacttggtcacttaatgcctgctgtgtgtggggtctgggagggtgtataaagctgcctgctttcctttgtcctttaatcagctacttctgcctcttttctcctcttgtgataactgtccccgccctcccagcttcgagcacgttgtgaagattgtagagcagtgacctgatattgtgtcagatggggcacagacaggggagtttgctaaggataatgactgtagctatacctctggaagttctcttatatactggaggggtgcgaagtggctggttgggatgtccctagtcccaggctgctgctcccacttccttataaggacaggactgagactgggcggtggcgaattccagccctgagaagtgtagtagcagcagtggagattggcaggcctccgcgcaggaagtgcgagttgtgtaaatggatgttaccaggctgccagaaggggaggaagcctctatatagaacactttgagttgggaggaagagaaatagagccctcttaagtagactttggtgtacagtttggtgcagatatctcgtttcctcagcatgatcaaagttgaatgggcacgagagctctgaggtagggtttggattaaccctcaaatcctgtgttgacattcatctgaatcctagagttcaaggaggccttccagctgtttgaccgaacaggtgatggcaagatcctgtacagccagtgtggggatgtgatgagggccctgggccagaaccctaccaacgcggaggtgctcaaggtcctggggaaccccaagagtgatggtgaggggcctaaagaacaactcctcattgtcatgggcccacattcttcagctaagagcttccctttatcttcataggccccaaactcaagcaagtctggattacgaaatcccatggatttccttgcttttagtggggagtcatctgtcatctctctgttcagttgaggtctctataatcccctgtcctgagaacttgtgttacttctctggcctgacacttcacctcctttatggcagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtaaggttctgtgtccttgtccttgagctgagatggcaccctaggtacctcacttgtcacccaattccaaaaatgctttctttccccctgcaggtgagaagatgacagaggaagaagtagagatgctggtggcagggcatgaggacagcaatggttgtatcaactatgaaggtaagaggtgaactgcgctttctcagagaaagcagccatatggggcaggtcaagtatagtgtctggggctttccctatccctggacttgggctccaaaaagagccaggaggcaaggtgcagggccctgccagcccagcccaggagtgggaggtcagggcggtataacaggaaaggaagggggtagtagtgtagagggtgggaaggaatgagaagtgaaataatggaatgtctgtcccactgcctgacccctcaccccatgtctttgtacttgtcttcaaccattaatgtctcttccttcctgcagcgtttgtgaggcatatcctgtcggggtgacgggcccatggggcggtacggctcctcccagcctctcctctagttgatctccccagtgtttcttttttccccaacctgtgctctttatcccctgcccttaccctactacnatctgacttcntcctggcatgtttctgcatggagctgactagggaggggagggattctcaaagaggaagaccaacctgggggtacagtacctccttactctagaatgggccctgaggttttacttatgcggccctgggtgctggtgtctgggaacctcaccagcctgtataccagtcttgctttagggtgaccttctggccctggagcatgggtagctggcatagaggggtatgggttgcctgccccattctgctgctatagctgaacagtcctttccccttccctcgctgggcagcttggcaggtaccctaacccaaaactctgtcctctcctcccgccagtggctgacagtagctgtaggtgtagtggagaacttttctgcctctgctgtgttcttgctgcttaggtttgggtgggggactaacagctgctgggaggggagctaggggcatggagaactggtcagactcaaggtggctcctctgcaaactgaccccagggttggttgctgtgggcatgttcccgcttatgctacctttgcagtctggtagtcccctggcccttggcgtacccctccacagccctgttccctggctcatcccacctttcctttccacagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggttcggttctttctttcctgaacagggtaaaggggaagaaggtgagatggtgatgatttctgccctgaggcagagtccaaggtcaatcaatggtgcaggggttgaggaaagctgggggaggccctgtactagccatctgggcttcatttaaaaactactggccccattcatccatcttacacagctacctctt

SEQ ID NO: 50 - protein, 103 aa, Homo sapiens
MCDFTEDQTAEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 51 - DNA, 4204 bp, Homo sapiens
caggacagggaagagcgggcgctatggggagccggacgccagagtcccctctccacgccgtgcagctgcgctggggcccccggcgccgacccccgctcgtgccgctgctgttgctgctcgtgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggcccagcctccctgaagcctttgcattttggagagtttcctgaaacaactggaaagataactaggaaatccattcacagttctttgggccagacatgccacaaggacttcctgtccagctccaacctgcaaagatctgtcctcagccttgccagagatccaaaagaagcccccagtaagaacctggaacttggggagttaagacctggcagctctggacagccccaccctggtgggccaacaaagaacactaactatgcatggtgccccaggaccagctcaggacagatgccacaaggatagatgctggcccagggccagagcccagctccaaggggaatcagaactcaaatggggccagatccagcctggggtctggagttgatctggaacccagactcagacattggcaccaatccaggcagatccaggactatatttgggcctgctccagacctgatcctggaggcccagttcaccctgatttaggagaagccaggaatttcccaggacctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaa

SEQ ID NO: 52 - protein, 1049 aa, Homo sapiens
MGSRTPESPLHAVQLRWGPRRRPPLVPLLLLLVPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 53 - DNA, 149671 bp, Homo sapiens
gatcagtgggtgtcaggggttagggagagggaaggatgaataggtgaagtgcaaatgattttagggcagtgaaaatactctgtgtaattctatgatggtggatacatgttatacatttttcaaagcccacagaatgcacaacaccaagagtgaaccctgatgtaaactatggacttttagtgataatgagatgccaaggtagtttcatcagttgtaacagataaaccactctgttgtgagatattgataaagtaggagggtatgcatgtgtgggggcaaagtatatagaaactctatattttcactcaattttgctgtgaacataaaattgctgtgcaaataaagtacattaaaaaataatgttcaaagaactaaaggaaaccattctgaaagaaaaaaaggaaggagtaaaaatgaaggagtaagaacacctatacattctatcctccataaatgcaataagaaaactggttttaaaattgtcagaatcaactcttttggacatagacattaactaaagtcttacagcagtctggggaccatttatttaaaaaaaatgggtgaatcttaataagaacagcaagccacaagtcttacgacatttttatctttagtgttcccacctcctctttcccagttccatggtacttttgaaaaccaacagcccactatcatgatgaaaattagcaacgtggtaacaactacatagggcaaaacagggttgagatgcttcaaagcctcattcagagataatttgctattatatgacctctttggttgttcctctgaagacctgactgagtacaaaaagacctttcccagggggtttatcagaaacagaggcaactgttttaccaacacactatccgaggtgtggataagagttggtgcaaacactaaactaaccaaaaagtttaaaataaaagcaaaaaaacaaaaaatgggacactcataggggctttgataatcttctacatattcctggaaatgtagagggccattcacatgtttcgggttgtatccatggtcagggccgagcacatgctcataaaagacttgaggaggccctaagctctcacctctggctgtcattaaggtgctgcacaagcaggaagtaaaggttaaaatgaagttgtaaactgcctggctgagggttgaaatcgtgtttcaacatgtacacagagcccttcagtgaagactgttaggcttattggttctaggcatttcagttaatatttgttgaatttttagctggccactaagataagcaagcagaggcttcaatggttacacataggaaaaaaaaagattttgcagaattagtagtgaaaatttatgaaataaacaaatagagacaagaacaaacactggggaggaggaatacctcattccagcatactgtctatctatatctgtttatctacaatttaaaagaaaaacaaagaagttaaaaggattaaaaccacacaaaatatgttctctgaaaacaatggaataaaattagaaatcaataaaaataaaattttgaaaatgtatacgaatatgtgttagttaaacaatagattccttaacaacaggagatcaaagaagaaatcacaagaaaaattagaaaataatttgagatgagtgaaaacaaaaacctaacttagaaaaacttatgggaagcagctaaggcactgcttagagggaagtttatagctgtaaatgcctatattaaaaagaagaatgatcttaaattaataacctagtgttccaccttaagaaactagaaaaaaagaaaaataaacacaaggcaagcagaaagaatgaaagggtaattattaaagcagaaataaattaaaaagagactcaacaaacaataaagaaaatcaacaaaaccaaagttggatctttgaaaagaccaacaaaattgacaaagctttagctaacctgatcaagaatcaaagggaaaattcagatgactaaaatcagcactgaaagggaatatgttaatctgaagcttacagaaataaaaaggattataagaggatatgatgaaaatttgtatgccaacaaattagataacctagatgaagtggacaaattcctagaaaaatacatattactgaaagtgactcaaaaagaaatagaaatttgaatagacttataagaagtaaagagattggatttgtcttcagaaagctgctcacaaagaaaagcccagaaccagatggttttactggtgaattgtaccaaatatttaaacaattgaaaccaattgttcacaaacccttccaaaaaattgaagaagatacattctccaactcaaacaaatggtagtctgacttttagttttctgaggaatcttcatactgttttccacagtggtcgtactagtttacattcccaccagcagtgtaaaagtagtcccttctcacatccatgccaacatctattatttatttaacttttaattatggccattcttgcaggagtagggtggtattgcattgtggttttaatttgcatttccctgatagtgatgttgaacattttttatatgtttttatatgtttgttggccatttgtatatcttcttttgagaactgtctattcatatcctttgcccaatttttgatgggattatttgtttctttttcgatgatttgtttgagttccttgtagattctggatattactcctttgtcggatccatagtttgtgaagattttctcctacttggtgggttgtgtgtatactctgctgactatttcttttgctgagcagaagacttttagttcaattgaatgccatcaatttatctctgtttttgttgcatttgcttttgggtccttggtcatgaagtctttgcctaagtcaatgtctaaaagagtttttccggtgttatcttctagtattttgatggtttcaagtcttagatttaagtctttgatccatcttgagtttatttttgtataaggtaaaagatgaggatcaagtttcattcttctacatatggcttgccaattatcccaacaccatttgttgaatagtatgtcatttccccactttatgtttttgtgtgctttgtcaaagatcacttgactataagtatttggctttatttctgggttctctattctattccattggtctatgtacccatttttatacaagtaccatgctgttttggtaactatagccttgtgatatagtttgaaatcaggtaatgttatgcctccagatttgttctttttgcttaatcttgatttgtctatgtgggctctttttaaaatccatatgaattttaggattgttttttctagttctgtgaagaatgatgatggtattttgatgagaattgcatcaaatatatagactgcagctgggcacagtggctcatgcctgtaatcccagcactctgggaggccgaggcaggcagatgacttgaggtcagaagttcgaaaccagcctggccaacatgatgaaacctcgtctctgctaaaaatacaaaaattagctggacatggtggcacactcttgtaatcccagcaactcaggaggctgaggcatgagaattgcttgaactcaagaggcagagtttgcagtgaaccgagattgtgccactgcattccagcttcggtgacggaatgagactccatctcaaaaaaaaaaaaagaaagaaaagaaagaaaaagaatatgtagattgcttttggcagtgacatacttgttggactttctaacttgtcctagacatcctcttttcttaagcaaccagttattttattttaggacaagaatttcccatacaagattctttgtaacatttcttaccataaatacctcttcacctttgtaatcttttaattagacgagctacttttattctgttaggaagttatggtttgtattacatgttgttgtgtgagtcctgagaagagggagcagataaggaggttatctacatgatgtagaagttatcccccatcaagggattgctcggttagatttcttgtttgtgtgaataagtgtgggctatatttaaaactcctgaggtaagaatatttaggttgaagctattggttatagatctaggtagctttcctgggagaaatagggctattagagggaaagaggaatttagagtttgggtaaatataaagcagacacccatcttagaaagtatattcttgtcccaaaggggggtggggtatttagatattaccagaaactcttgggagaatggtaatttatcctttaagtagaataaagtggtgtgaatttttctactgaaggaaggggtgccacttggccccattacctgacaggatttggaggagagttgcttagagaagaagattagtacagagtaggcagttcttgaacttaaaaaatttatttattttacttgccacctccagagttgcctttggctttgtcttgttgatgatgactctgatttgggagccagtcagagaagagagtacctgcagctcaaggccattaggggttgggattctgttctggggaacattttgacccttagggcagtttcattttcagtagccgagcttgtggcagaggggacaagccacgcagggctttttcacatttatcccattaaggcagtttgcctttcagtggcctggtcttttgcacgatggcagttacctgtaggagtgtccttagggctacctggagggggttgggggcttgtaaaacagccaacagttgagactgcctaatgttcctgtgtttttcttttttcttagctttgttctccttattcggctctcagttataaaagaatgaggaggctaatttgaggatttcctgcataggggccatgctgtattacacaagaaaattagacatttctttttgagagtctgagggttaaattaatcccagtgttttaggaagcaaccccgaggtgagtctgagggaacagatgagatttgtcctatgatgggactgaaaatgacaagctgctgggggtaatgtccgctgcggtcatgaactgcactttgtctcagggcatcctgccgaggaaaagggttccactcacgtccactgagggacttcgagatgcactttccaaaggggcatcctacctattggaaggatctcccagcattgtggctgatggccctggggttttatgctggatggctagtccaggtaggaggaatgaggatgaatggagaacacagcctggaactagcccaggagaaggaatgggaatggggagattcacctgaggccacttgaaatcatctgatttggcaacatccagagcaggtttggctgtctttacagtagaatttagaatgaggaagagggggtctgagttccccaaaacatgtgtaggttagctttagtcgagctttagctgccaatcatgctacatgtagggattggggactttggggagagagctttcctctcttccgaacaaggcagacaaacctgttcaccccctgaccttcagactccaccagagagtagctctggccagtgaccatcaattgccagaaagatactggaattttttcacaggaagactggaaagaaaaacaaaactctaaactcccacccaattgggcagtggtcagacgtgctatcaggaccttctggtcttctggggagtggcctcagctgggatcgtcaattggctccaggcttggacactgtccaccaagaggttggagttagggaagagaaaagggagaaactaggagacacgttcttaagcagttcctgagcactccctgagtagctcccgagcattcttctagcagtcttggagcactccctgatcagtcccacacactccccatatgggccaccaaaatgttgtgggtgcaactagctggggctgatgttgtgggcagtaaaggaatttactaagacagttgtgggtaaaggaaaaagaatttattaaagaaagtacaaagacatgttgcaagaaagcaatgggcagcacagcagggaagaggctgcctgcaaagaagcaggggatggacaaaagttttataaggtcatgctggagggggctatgtgcaagtgaatttgtgctgtatgctaagaatatgttggggtaatttttaactgccaggtctttcctatccaggtgcccaggggaaacactatgctgcttttagctgtcttgcgacccacatgctttccgtttctggtgttgcaagatactgactgtggtttttcacacaaagaggtgagctctgcaaactgggttaggtccctgttctgccagcctggctcctccctggttcctgttaacttattgatttactggggccccaaagttaccaggaacttgtggtaaggagaggagggtagtagaaagtgactgataatgaatatgaagtttcttttagggatgataaaaatgccctgaaattagatagtggtggtatttgtataactttgttttttttctgttgttgttgttgttttttgacataattttactcttgtcacccaggctggagtgcaatggtgcaatcttggctcactgcaaccgctgcctcccaggttcaagtgattctcctgtctcagtctcctgagtagctgggattacaggcacctgccaccacacccagctaatttttgtatttttagtacagatgaagtttcaccatgttggccaggctggtctcgaactcctgacctcaagtgatccgcccatcttggcctcccaaagtgctgcgattacaggtgtgagccaccaggcgcagcctataactttgtgaatagactaacatccactgaattatacattttgaaagtgtggaatttgtaatatgtgaatttcatctcaatattaaaaaattacaattaaaaaacaaagtaaaaagatgccacgagatttatcaaatggagaatattaatatagaggtgtaaattatttttaaaaataaccaaacagaaattctagggttaagaaaagttcttcatgctgaaagaaagtgactctagacagcaatttgaatccacacatagaaacaaagagcagtagtaaagttatttatggaataaaagacagtgtaaattcatatttcttctctgttctccttaactgatttaaaagacaattgtataaagcaatatgtatactgttgggtctataccatatagaaatgtaatatatttgacagtaatagcccaaaggaggtagatgagagcaaatttatattaaagaaagaaaatataacaaaatctataaatgtatacttgctttcctctttttctccatttctttaatagacttgaaattgtataaagtaataacaatatattattgcatttgtgacatatataaatgtaatatatatatatatatatatatacataacaataatagcacaaaagggggagataatagagccatgtaagtgtttctttatctcaccagaattaagtttgtataagttgaaggtgattttcacaagttaagacgtatatgttaagccctagagcaaccactaacaaaataactaaaaaaaaaaaaaaaaaaaaggcagaaaacactaaataaattaaagtgttacattaggaaatacttactgcaaaagaaagcaataaaggaggaatagaggaacaaaacatgggctccaagatcagaaggaataattcagaagaagaaataattctggattttcaagtttcaagagtggattttagcaaagaccctttgggcctacactgattgcaaaaaaaacacacagctcagcaaatccctaacagacagtacttgggcagggttttactttgcaaagatattgcatttgcaaggagcagtttatggagctatctttattttggatatttttccacaagcccttttctatttgggtgagactaaattctgccactggtaataagacccttaccttaccttctcagaaatgtagaccattgaacagtttttcacttatccagaaaagtggcagctgaaccaccctgctgccaagttgttctatttacatagacccaaaactcaccaaagatacccctaaccaggatgaggaagaaaattgtactaacagagaaagacaagacaaggggctcaggctaaactagaagttttcttggagaggtcaatggatatgtaaaaatagtgggtggaattgacacttcctaaacccctctgacaagatccaaaccaagggctgtgagaaaaattaagttattctgggattggaagactttcagctatgggtgggcgaattggctgggagacagaaaacaagaggttaaaataacaatgtcttttgacagcaaattctaccacaggacaggtctgcaatttcacatggttataaataatctgaagagcaaggtaatgcttttagtgaaattgagtttctaattcatacagcaagtgttcatgtagaacctatgtactaagcttggtctggcagtggaagattttgtgatgaaaaagacattgccccttttgggagggattgtataatcaggttgagattcacacgtgaagagagccactcagtgtcatttcattcatgagctgaagccaggggaggaccagacaatatggtacattagtgaggaggggaggatggacaggaggtttccgagggaaagcaagactgaagctggtcctaaaagattagatgttgggactttggggactcggggaaagaatgggaagggggtgagggataaaggaccacaaattgggttcagtatatactgtgttcgggagatgggtacaccaaaatctcacaaatcaccactaaagaacttactcatgtaaccaaacaccacctgttccccaaaaacctatggaaataagaagttaaaaacaattacaaaataaatttaaaaaagattatatgttggaattcagaaagaaagaggaagatcatcccaactagagaaagcagcacattcctagggaggagccattaactcattcaacaaacattgagtacttactgtgtccaggtaagttgttggagaatacagctgtgaacaaaaaaagtccctgcctttgtgaaggttatattctagatggacagatgggtaataaacaataagaaatagataaattagatcatttcagttagtgagaaatgttatgaaaaaataaagcaggataatgaaatagagaatgaattcaaatcatggtttgcctttttattagctgtgtaactttaggaatgctgtttaacttttttgtgtcttagtgtccttcctcatctataatatggtgcaataacagcatttatcttgtaagagcatagtaagggtgatttaatttatgcaaaagggcttagaacggtatctggcacattgtaagccatataagttagctattataggtgtgtatgtgagttgggaagtggggactaattcagatagggtgataaaggggtacttctgtgagctgggacctgaatgatgaggagccggtcatgggaaattctctggcaagaacattccagacaatggggcagttaaaggcctgatacttggatgagcttgggatattaatggaaaagaaataaggacaatgtggctgaagcatagtaagccagggaagggtgctaagaggtgaaatgaaaaaagaggtgagaaagggccagattacatagagcctggaaggtaacagtacagatttgaatttcattctgagtgtgattaaagaaaaaaacccatgggaggtttaaagtaagggagtgatgtaacctaatttacacttgtaaaaggtctctctggctactgtgtgaagaatggactgtaggagagcaaaagtggaggcagagagacctgttgggaagtcatttcaattgtcctgaccagaggtaataatggctcagattaggtgatgaattggaggaagtaaaaagtagttgtgtttggagtcatatttgaaagaagactggataggccgggctcagtggctcacacctgtaatcccagcactttgggaggacaaggtgggcgcatcccttgatgtcaggagttcaaaaccaggctagtcaacatggcgaaaccctgtctttactaaaaatacaaaaattagccagaagtggtggtgcgtgcctgtagtcccagctacttgggaggctgaggtggaagaatcgcttgaggacaggaggcataggttgcagtgagccgacatcatgccactgcactccagcctgggcaacagagtgagagtccatatggaaaaaataaaataaaataaaataaagaaagaaagtagactggacaggccttactaccgatgaactggttctaggagtgagaaaagaggaatgatggtgcctgatttgggggcctgagcaactgggcaaatggtggcatcatttactgaggtgaggaagattgagggaggaaaggatttgggaagaaaatcaagcgttctgctttgactaagtaaactttaagaatcgtattagatatgcaggtagaggtttcaagggagcagttagttgtccaaattgaacttggagagagttatggactagagagataaacatgggagtcattaatacataggccataattagtcactgaactgggtgaaatcacttgtgccttgcagagaatgtgagaccaactcaggtaggaatggagaaactgaacaaagaaaagaagagtagaagtttctgacaagttactggcagcagaggatagaaagttgactggagatctagtgaggaggccactcactagaggcaacggtcccagcagcagaagagaagcagatatggcattaaaaagctatttgcagaatgaaaggcaggagattgggcactgggaccgcgctagggaaagaaaattgtcaaggagaaatatccaagttcttattctggaaaaaggcgtggatagtggcgccaccaagtgagagagaggcataagaagatgagccaagtggaataagaataaaaataatatatttgttattctgaatttgaagctctaggaaacatttaaatcttgcctctgtcactccaagctatgtgactttgggcaagttacttatcctttctgtaccttagtttccttatctgtaataactgcccttgtctcagagatactgtgaagatatgtggtaatacctgtaaagcacactgaacagtaagtatttaataaatgctaattacaattattattgcaatggaacgtcattatgagaaagtctgggattttgagggatgccaggtctagtatgcctggaatgcaaagtgctgtggggagatagatgatgatggatagtggaagataagacaagtcaaatagtgaagagccactaggctaaggaattttggcttcttcttcaaggaggatccagagtgagggttgtttttgttttgttttgttttgttttgttttgttttgttttgagacagagtcttgctctgtcactcacgctggagtgcagaggagccatctccactcactgcaatcttcacttcctgtgctcaagtgattctcgtgcctcagcgtttcgaagagtagctgggattacaggcatgcgccaccacaccttttgccattacttttaatggcaaaaacagcagtaacttttgcaccaacgtaatagatttttatggagacttcattatgtaggcatggttgattaaactattagccattggcaatcaacttgaccttaagcccctctcccctccctggaggttagaggaaagtcccaaccttctattcatgctttgtctttctggtgaccagtcccacactgaagttattagtcaatcattagcatacaaaaagacagcactttggagctcccaaggattttaggagtggtatgccaggaaataagaggaagaccaaatatatatatttcacaatatcgcagtagtccattcatttttattgttgagtaataccccatttatgaatatacaattgttttgttcattctcctgttgatgaaagtctggctagcttccagattggtgctattgcaaatagtattgctatgtcttttggtggacataagcactcattgctcttggatatatacccagcatctctacccattattttttaaattaatttttttgaggtctttgtagattcacatacagttgtaagaaattatacagagagatcccatgtacaatttactcatgttctcccagtggtatcatcttgtaaattagccttcaatatcacaaccaagattttaacattgatatagtcaagacactaggtatcacaaggacccctcctgttgctctctcatagccatatccatttctcacatgctctccatcccctgccttgttctttaactgcaggcaaccactaatttgttcccttctccatttctataatattgtcatttcaagaataaggaatttcaagaaatagggaaatggagaataatgctagagtggcttaaaacagaacaaattctggaggtcagattgtcagagatgcttgagccagagctacttcatctagaataggggctgggtaaaaaaaaaggctgagacatactgggctgcattcccaggaggttaggcatttttagtcacaggatgagataggaggtcagcagaagatacaggtcacaaagactctgctgataaaacaggatgcagtaaagaagccagcaaaaatccaccaaaaccaaaatggcaatgaaagtaacctctagcagtcctcactgcttattatacactaattataattcattagcatgctaaaagacactcctactagcactatgacagtttacaaatgccatggcaacgtttggaagtcactctatatagtctaaaaaggggagagaccctcagttctggggaaatatctcccctttcctagaaaactcatgaataatgtttagcatataatcaagaaataactacaagtatactcaatcaagcagcccatactgctgttctgcctatggagtaaccataattttactttcttgataaacttgctttcactttactctatggactcacctcaattcttttttgtgagaggtccaagaaccctctcctggggtctggatcgaacccctttccagtaacaagatgaaagtccaaaatgggctaaaactgagctaaaactaaggtgtccacaaagctgcatttcttctggaggctctaggggagaatccatttccttgactctcccattttatagaagccacctgcattcattgtttcatggccccttcctccatctttaatatcggcaacatagcatattcaaatctctctgaatctgaccctcttccatctttaatgactcttgtgattatattgggcccacctggataatacagcaccctttccctatcttaaaacccttaacccaatgacatcccaagtcccttttgcaacgtaaggtaacatatttataggtcccatggattagaacatggatgtctttagagggccattatcttgcgtgccacatccatcttcctgggagaagtctacctgttttccatttaaaataaataaataaataaatcatttacacacatacaacccaatatccaaaaacagagatcctctggttgtggttggaggggatctaaaactccttcactttccaaggcaacaacagttgggataatcattagcagagactcctaaggcctcctcctacactgatgttctagggacttcgaactatatctgctaccttagaattgaagctgtgcaaatgtctcctcttcctagtatatgtctgcccacccccaggaggacatactggaatcatcaaatacatacactggtgcctggatcccaatactagaggttataatttgatttgaagatatggtctgggctttggaatctttaaaggattctaatgtgcagacaagtttttgagccactgcctcaaagggttgttgttaaggatttaaagctcacaaaacatacgataactgggccaggcctcatgggctcccacctgtaatcccagcactttgggaggccgaggcaggcagatcacttgaggccaggagttcaagaccagcctggccaacatggtgaaaccccatctctactaaaaatacaaaaattagccaggcatgatggtgtgtgtctgtagtcccacctcctacggaggctgaggcaggaggagaatcgcttaaaggttgcaatgaggcaggattgcaccactccactccagagtgggcaacagagactccataaaaagagtaagagagagagagagacagagagagagagagaaagaaaggaaggaaggaaggaaggaaggaaggaaggaaggaaggaaggaaggaaggaaggaagggagaggaaggagggaaggagggaaggagggaaggaaggaaggaaggaaggaaggaaggaaggaaggaaggaaggaaggaaggaaggaaatatatgataacttacttttccttgcaagtgttggcttaccaggaaggaaagtggtaagtgagagtgccaggtccaggacagtttagaaggtttgtctggcctcagtttcctcatctgcaaaatgaggataaccatatctaggctacaaaatgttttatacatgttttataaactataaagtactacccaatagcttttgtacatacacacactctccatcctcacttcacactccattccccactgccttctgcaacagggcccaaggtagtttccctgacctttattggcactacaatatgtgagggtagtaggaggcaggaaaagcctgaagaccttcctgacaaagaggcaggacagggcctgagcatcccaagagaaatcaagagatacaaataagtacctcttaggtcccaatgccaggcaagtccaggagcatcacatggtcaatgcaggatccacacccacagtagaaaagttggcctggaactaccgaaagggcacagactattaagttagacagtcctgtgaccttgggaagttattatacttttttgagcccattctctcctatataaaatggggatagtcatatcacccctctccatagaactgaggtatagatgaaatgagaccaaagataagaaggtaatatataaatagaaactgcagtgaaatatcttacagctacccactcataccacaaagaacgattgagtcactgtgaagtcttcctaaattttattggcactgaaatagaacatggattgagcataaacccctccaaaaacaatttttaaaaaacccaaaaagtacacaaaaaacccctgaatacaaaatctaaccttttcccccagcctccctaagggtaagttactgactttaaggcagctattaatagattgccccacaattccaggtttcaatttagccaatataggacatatcaccaagtgagctaattcacagcaatgcacacaagactcctcaaggtcaggcacagagtggggggtggtggccagggggaattgagggaggctctaagctaggggcactgcatggtgggacaggatggccccttgaggactgaaccctggggagaagacaaacagtaataataaaaacaaataacaagtactttaagaatggattgtatgacctatagtgacagatgacatcactaatactgaaagcttcttatattaataattttggcaaaatgtcattttgtaatatagtatatgctttccaggtgtgggggtggtaaagtaatgaggccaaaatcatcctgccccaagactaatatcttctaatggtgcattagcaaggaaggcagaaatcaatatttagatatcagtagagtacataatactgtagaaagaagaagagcacacatgagacagagaaggaggtggatgctcctgggttgagagcaaggggtgggggtgtggaagggactaggccagaatccccagcagctctctggtttacagctccaagggacagaacagctggtgtcaagacctgggttagaggtttgtcaaacagaggcagggcccagtcacctctttggaggggagtgatgagaaggggattttggtcacctgagagggttgagtaaacttggatcagggcacaggcttctctcaccatactcagctttttgcactcactccctagttgagcctactggcatcaagctctagatgccaaggctgggatggctgtggagcaggagctatggcccaagtagctctgagaggggaagagacctaaaacccctagcagggaaaatactgacgctaggtgtgaacatatcctctcttttcacaagagtcctgatggggctggctgagcttttgggtactcatccctactgttatagctggagaggatttgggtattgaagcagggaggggcagatcccacgaagtgactgcagatctggaataataagtaaggggtagatctgcccatagagctcactttagaccggcctatactcctacaaggaattggggtaggatcttctactcagccttgccacaatagaatggccaatgcccttctagtatgtttggtgaaggtcttgaaggcaccatttcccccatccaccctggggagaaattgagtccctaaagtcaacgacaaggcttattgaggctgagtttgcaacagatccgatctgggaggtagaaacaaaaatgactgaacatctttttatcccccaatcgttacaaagcctaaataactctaaacgggatgggagggcaaattttaggtcagttgacatcctggagaagatatcctaggtcctgtctcattccctagaccgcataacactccaaccgtgtaaatctcaggaccctgaagaagacagtggtaggggagaggaggggagctagcttccaacctactccacacttgactcccataggacaacagtaagtgtaagggcatttgcaaaatcaagtggaaagtacctctaggctggagaagtaggatattctagccatacagattcaatggaacagagaagagaaaggaggttccattggcaccatagtgagccattcatttgcccagggaagtgggtgggggctaaggggctaggtttggtcccatggctacattaaatgcttggcatgactccagggctgctctagttagtggctccagcacagtatgagttaggtgagttaggtgtaggagtgtggggacaaggaaaaagggaggaggggtccctagaggctgggtgcccattacatagactcaaattcgtcaatgcgctgcttggtgttgccctgccggatctggcgcagggtcttgtatttgtctcggcccagtcgcatgttctcagcatggatcatgtcattggcagtcttcttggactcatctctggcattggccagctccgaagtgagggcctgtgaggatgtatgggaacacagaggtcaatggctttctctcattttacctcctgttatttgaccagacttcccttctcttctgtttccttctttcttcctcaccctttctctctatatataaatattgagagtcatttccaactctgttagaactgcagtggggcaagaatattaaaaaaaaataaataaacttaggggaccagttgataatgggtatcctttaagagtagaacaacatacaaaagattcaggtgggaattttgtcagctagatattttcttaatgtaagaggtgaatggagtgagtgggaggtggggcagagagaaaatctcaaaaagggaagagatagcccaaggtctgattaataagtgagaggtgcctatccttaaagctgtcacttaagaacggcttgggctcccatacaacactgggacaggatcttatacctatcccccatgatggtctagggaatgccatgggctactaaatcaatgcatatagtttccttgccccttggccctacttgtataccttcaggtgcttctgcacacgctcattcttctctgcctcagtggtacgttcctcctcactgcggtccttggccatagcatcagcccgtaggtcagcactagcctctgccccattctcatcctgctcatcctgctcattctcagcaggctctgccacatgaggtgtactcatggcagtcttcagctcagcacgggtcttctccaagtcttcctgtaccatctgggcctgtccagtgacagaaggagagaaagactgtcagtgagaccagttaaactgtggcatcctgtatatgcctagaacggtctggcaagaggcaggcaccaggtaggacaaggcacttcatctgcctgatccttagtttcttcatccataaaacaagagcaattgtaccaacttcctagaggtattagagaactccagtaagtatttgacgaaaccatgagtgccttctcccatgctgcctgctgtgggaagtatgaaagagggagggagccaaaacataaggaatctaaggagctgttacctatgcatatggcacccattccttcaatgctttgctttaggccctgtgtcttaccttctgctgccactccacagcctcactctccttcttctgtcgggccatctccagctgggagattcgagctgtcagctctgccatttccaaggcctacggataaattggaagcctgtgagagctgggccttctggtcctcaggacccaggtgtcttcaacccaagtcccctgggggactagtaagggacctactgctccacttgcttgctgcctcagagactcttttaccagactacttcattccagtcccatcttccctgaccaccacttccttttaagtcagagctcccccacctagactgtaggcctcttgaagacaaacaatatgccatctctgtcccttcctcattatctctccccctgcccctcttggcaagtatgcagctgggggcctcagtaaagctttggccatcattgggtcacttcctgaagtggcagatcctttcctgatatcctagaatgctcaggattcgactaagagtcttcccaggacaagtacaggaaagacactcaagtgtcacaaagctatctgaacaaggaaaaaagcttatgcacaccttgggtaaatctcccatgacagcttcctcatgagagacaggtcttggttccctctattcccacctccaacagtacaaaggaagagtatatgtcaaggagtttggaccacaggttcttaacttctgagtcacagaacccttggaaactgtgatgaaagtatggatgccaaatgccccaaaaatgcatagacacatagttttgcatgtgatttcagggagcaaagctttcaaacagaggcagaaatgggtgggttctaatccttatttagctacaattgtgtgatctttggtgaatctcttccctgagctctaatttccttatctgggatattatctcatatgaggttaatcccatagggttactgggaagaagaaataagtaaggaaaagggaaatattcccaacacagcaacatacagcaggagctcaaatatgagtcccttttgttcttttctccttccctttcctttgccaggtcaatcagctcagatacccaagagttaagaaagtgaacagaaactaagggttagggaagactgcaaaaatttctgggccacactagtgacttctcagcttgcttctgaactagttatttgctggaggcccatggagtggtagcctgctctaaaaagccagcatgtaagcaaaagtagctataagtaagtaggcagacaaggaagaaagttcagttcccataatcccagcccaccctacagctttaccagctgttcctgagtctttttctggtcccgggaggcctgcagcaaggcctccttggcctcttcagcttcttgacgctccttggccagcttttcagcctcgctctgggcacgcttccgttcctgctcaagttccagagccctacgggtctgttcttccagttctgagcagaaaaggaggggagaaggcagtgaagagcacagagataaagacgacacaatagcttcgttcctggaaatgatccaccccaagacaaagctggcagaaagttctgagctctcttcttgcccattcttcttctagtctgtagccacacctgaactacattgtctgagtctacagctcaggcagaaggttctccagctcagagttaggcctggaaaaatccaatctccaaggtgactccaagcctcaccttgctgagccttcttagtctgttcctcgatctgcttcagcctctccatcagctcctccttctcccgttcaatcttctctttctccttctctgccatttcacgcttcttcttctcattttccagcatagcactagggaaggagataaaatggatagaacaggataacaacgctccacaaaagcctggggaggccaggcgcggtggctcacacctgtaatcccagcactttgggaggccgaggtgggcagatcacgaggtcaggagatcgagaccatcctggctaacacagtgaaaccccgtctctactaaaaatacaaaaaaaattggctgggcatagtggcatgcgcctgtagtcctagctactcaggaggctgaggcaggagaattgcttgaagacaggaggcggaggttgcagtgagctgagattgcgccactgcactccagcgtgggcaaaagagcaagactccatctaaaaaaaaaaaaaaaagcctggggaattccaaggcttgctgcctctgggtctctcaacccaaccttcccaacacacttagggattgtgagtttgggccaccctcccttacctctatacccttgtcctcatatcatagccccacataggccagtgtacacggggccctgtcaatgtacccctgagtcaggaatcctagctctcccaccaacccactgggtgaccttagctatgtcactgctttgctcttgttcccctatcttgaaaatggtccaataagacctgccctatccaccttgttagggagacaagttttggctctgtgctgggatgaagtgcttcaagtctagtaatctctacggctagtgcatcagtcctcaggtctaacactgcctgccctaaagcccagctctaggcttctttttcccagagtctgttacaaatctggaataagtatttgcttttgctttttcttgccctagcacctcttccaggaaccttcttatctcccttggctaggtattctccatctgggccctcagaatacttggcttacccttctccccatccctcttctatgtttttgtctccatagcacttcttaaccatcttatgtaccacataatttgcttatttattatgttcgtctcctccccactagaatgctagcttcacaaaagcagagatttttggtcttttcttattcattgctcaataaatatttattaagtgaatgaatgacatggcctttgtaccttgagttatgtatatattgttttccctctctctgctactagactgagtagactgtgaggtcctacagggcagtttcctgctagatccagctctgtaaaaactgcccctcaaacttggtagattttttctgaataaatgtgaatattggtgtctaacctctcatctatgaagtcctaggttggcctcatgtcctgacttagcatgcagggcacctttgagaagcttccttgccccagccctggccccccacatcagtgtgcagcacctaccgctccatctgcttctggtgcttctcctcccgggcctgtgccttcatctgctgcacctcaatggtatcaggcttgcgacggcgcatgtatagttcatggttccccatgcacaaggccaagatccgcttgttaatccgcagccggggagcatagaagacgaagtcctggtgggaaatcagcaatcagaaagaatttggagggacaggtgaaggtgatcttctgccttctgaaaagctaaatccaaaagcactggaaagaatatttaatctgacctcctgcactacagatgggaagactaattatcagagtggtaaagtgacttgcccagggttagacagtagacagacccaagactagaaacccaggtttcttgactctgaaacccatgttcttcccataatttctttcaatctttgcttatgaaaccacaatttctttcaatctttgcttgtgaaagcatcctaaattactcttaatcaagttgaaggattcaaactttctctgctaattagggaacatgctaggtctcaggtgacctcttttggaagccaaatgacccctgaataataccctggtgggtgcagtatgggtggctggactgtttctacaatctcctaaaagcaaatcctagacccagccccttaaatcctttttggaacaaggcaggctgtaaatacatacatgaatacataaatctcctgatcactgcttgtcctggttgttgtttttaaaatgagcccttgatctcagctggctttgttacttaactttttctgataatagttgagcacagcagcaataaaagaaaacacacaagaaaatccagtgagtttgagtttgttactacaaataccactggaccgaagtcaccagctgatgggcaccaccatctcctctgccactgaccacacactgctactgtctcatatagcttggggtgcaggtataaatcccagctctaccatttttagctgtgtgatcttgggcaaatcactccatctctctaacctcagttttgtcagccataaaattagtatgctacttagtacctacctgaccatgttgctgagggtttaaggagacaacatgtgtaaagtccctagcaggggaagttcaggcacctcatggctggagaagaatcactgagccttcatgaaaagggtcaggctcagcattgtcactgggccttgttggacatgcagtatcccagaaaaggggacactcagctcagtttcctaacctacccacaatcaccagctgtctggtcttgtcagctgcaggctactgagtgggtaagaagcatggcgagtgtgttagagaaatgaatgaacttaaagcacttttttggtcttggattgctctggagaaaagtctgagagggcagcagtaaagttctaccaagaagtctgtaggatcatcttcagatttggactttggccacagccctttctccacaataaaaaaaaaagaagtcaagggctgggcatggtggctcacgcctataatcccagcactttgggaggccaaggcaggcaaatcacctgaggtcaggagttcaagaccagcccggccaacatgttgaagccctgtctctactaaaactacaaaaattagccaggcatggtggcatgcgcctgtaatcccagctactcgggaggctgaggttgtagtgagccaagattgcaccactgcactccagcctgggcaacagagcgagactccatcaaaaaaaagaaagagagagagagagagaggaaggaaggaaggaatcaaatatgtgaacagtgtccactttctgggacccaggggcttggaaatatgagatgcattcggtttccaccccagaacctcagggcagcagaggcaatggctaagaagcagttcttaacactgcctgtggctctcccacatccacagtgagagagacaggtagcagagtagaaccaggtacaggatgtctgctggccatttcttggcatcaacatccccctccattcccaatctctatttgtgcttcctgttcgtgcacatgcgcgcacacacgtacacacaaacacatcagaaaaggaagagaaaaatagaatagcatgattgctcattatgcaggccttggcaagtacctgtcttggtcagagggaggaatcactcaccggggcttttttgtcaatgggcttgatgacaaatttcttatcattgaaagagatgttcctgatttcactccaggggaagcctatcttgggagttagtctgtagaaatagaaaccaataacatcaggacaagggcaagacaagaagggtgtagagaactgggggcttgccctcactgtcacctccaagcttctatgtctctctctctctttttttttttttaaaataaatagagacgaggtctcactatgttacccaggttggtcttgaactcttgggcttgagcaatcttccctcctcagcctcccaaagtgctgggattacaggcgtgagccactgagcctggccaaacaaacacttctctctggaggaggtagactcagtgacagctcagccagtgtcatcacacgccaccaggtcagctgccagcattgagagttcactaaagatctcctgatagtacaactaacatatgattccttgtctcaagtttgttttgttatgtatttgtttgaggcatggaacttgtaacagttcctcaagggaatccccagccctatttaactgagtctcttctatccaagcttacaaaagtttgagagaaagtaaataatgaactccaagattcaggagttatatggaacaataatttattgctctccatcctcaccaagagcacaccaagtgaaaaatataagcaagtgggataaggctacagtgagaggattataggccaaaagccacttaaccatcacaggagactaattacaaatgctgataagatagtctaggcctgcacgatccaataaaaacataatgactgtcacatatataattttaagttttctagtagccacatgaaaataagtaaaaagaaatggatgtaataaaattatagtaagtttagttaacccaatatatctaaaatattatcatttaaacatgtaaataaatattttttaaaatattaagacattttacgttctgtttttcacactaagtcttcaaagtccagtgtgtagtttacacttacagcagcacatctcaattcaaagtagccacatttcaagtgttcaatagccccatgtggctggtggctaccatagttgacagtgtgagtctagtcaatacaggatttagtattgactaagggaagttgtgaaatcatctgggctggactaaattaggtagaaaaagaactgagatgggacccaagagatatggccctgctccttggtgaaaagtgagccctagatgttaacgtgacctaaataaactaaaagagatctgagatatacctgtcattctgctcatagatgttgagacccagggcatccacccccagccacagctctgagcctttcttgttcttgatgctgaagtagttcacaccatacatctccagatcttgagcaatcttcagatattccaggacagcatcctccctaaatgacacagagttgggggtcacaaagtggggcttgtgagtcagacccaaggagatagaaagcctgcttactctgtacttctgacaaggatcttgctatcaggagtgggaaaggggacaaaaggcaagcagatgatggagaacagagcacagcatgacttttgcaaagcaaaatctcctaacaaaaacctagggtctaagctcccaaggggaataaagatgggctgacccttgctggcctctggcatgttggctgccatagaagcaattttctttctctcattcattgtgacagcctcttataaaggcacattcttagcagggctcagaatgtggtgatggcaaaatgatgatatttgtccttcaactacacaaccctcaaaaatgctttgccatgtgtaagagctccctccatttcttgatagtcaaaactgtttgggctaccagttaccagcattcagcaaaacaaacaaacaagcaaacaaaaaacagccttataatggtcctagtttgccttctatcgtccctgttccctctttctccaacatccaccaatgtcccttgtcatcagtctcttctccctagaacgcattctcattcaccctgtaagggaagtggggcccaccactgcttgggcaagcttacctgagcatgccacggtgttcctcatgccacacctggatccgctcctcccactggtccttgttgagtttgtgctgttccaggactctggaaagacaatgggtgatgagtagtttaaagcacaaagtccctgtgcaggagagaagggaagcccatttagctttctaaggggctgatgcaaagaggatgtagagtcagccaattgaggtcacactggaagcagaccgaaattatagcaagaaggtgttaaactagacacaaggaattgcctgaaaggtaagagagctacaagaatggatgatcaaaaacaacaaggggaacaccttcctttgtaccttcatccacaaatcaaatgatgtgctgtggtccctaagcatagcagtaatgtgtcaggagtttgtgctgactttaggggctaacagtagggatggacctcatggagtcaggtacactctctcctagatcctcttaggaccaacactctatgtttataagaatactgctcagaaatgaaaggatggcctttggctacagagcaatgaactgagtcctaatggctttcagaaaaaccaacaggcccaacctccaagacctactagattataaacaaggtttgctttaaacatgccatctcagatatcatggcaatgactcaggtagagtccccagggtacaagcactatccctaatatcttatgggtgtgttgtacatatatgccataactccaatgggactgaggctcccagaatgaagcaaagcttttccttctaatccaaaagactatggaaatggccattgggtatagtaggaaaaaacttagtgttaaaatattaaggtgctaagcttccaggtctggctctggctctgcctcagatgagctgcaccagatggggaaagtcagtgtgagtacctctgcacctctatttccttcgccaggaaataaggatattgcctgctttgttcattttgtgtgttattgtgatacaaaaacaaaaataatgagtgttttagagcttttgactttgaagtttacaaaaggggaaagctctgtacactagctgtcaatattaaaagactatttgagctccccatgtcctcggtttgcttatttctctctctcccctgtgaacttctgatataagagatctaaatcagtaaaaagaactgagaaaatggaaccagggatgggtgaaagaaattactcaatctctggttctatataagcacctgcctccagggtaataaagttctgtaaccaggtagacagagggaaaacaaaaaggctttttatttggaaagccagaaaaacaacaacagagtctgacactatatgcaaatgtctcttgagcagcataacacagtcttcagacagaccccaatggagaagaacagatctggcatccctgtgaggcagggattggtcagctgtgggctgcagccccttatggccaaggcaaaggagggcagggaaccacctcacctctgcgggagcaacttgtctccggccaggtagccagacttatgcacttccttattgaagtcgccatacttagactggacagcatacgaggccagcagcacagcggtctcaggcgggcagtaaatatcatcattgagaatgccctctttcacttgcagaaagaacaggcgctgagtgatgtcctgaatcaattcctcggacacatcctcagggtagaacttggcacggaacttaaagagcagggggctttccttccgcacatcctgggcagtcacctgggaagagtaagggttatggactctcaaaaaataggttttaagggtaatggagtggctgtagggtggggagaaaacactgaaagatcatcaatttgcataatcttagacagctgggtggcaactcccctggtaattaagaaaaataatacattactttcactggggactgaatcccatgtctgtaatcactttctgttgggaatttcttcctgaaattaccttaataccgactgatgatcagaaatcttcaaaccacttttatctgactatatccaactatccccaaattctgatagtaggcataagctcttcttttaagctcgtcttataagtctcctccaacttcataaattagcaaagtaaggactaggatatatgtctgaggactgagaactggctaaacaagagcacaaattagaccattttttaaagcctgaaatggaatactagtggctccacacttgtccagcaaaagactcaactctttaggaaaacaagactctaccagcagaaggtggggtacctactccctagacacaatcagagaagcaaactgcaggacagtatggagacttctaaggacaaggccagccagtttgaggatacgaagatggaaggctgccaggttcccgtgaagatgctgcttggggtggagagcttgcatggactcaaaccatcccatttggggtccaactgaggtaaaagatcaagaaagagggaaacatctatatggggttcagacattagttgactgctggagaaggtgcagcataagactgtaagatctttcagatttttttttttctagttcaagaatctgtggctctttttaacaaatccccagccaagctcagtagctcatgcctgtaatcccagcactttgggaggccgaggcgggcggatcacaaggtcaggagatcgagaccatcctggctaaaacggtgaaaccccgtctctactaaaaatacaaaaaattagccgggcgtggtggcaggcacctgtaatcccagctactcgagaggctgaagcaggagaatggcgtgaacccaggaggcggagcttgcagtgagccgagatggcaccactgcactccagcctgggcgagagtgcgagactccgtcaaaaacaaaacaaaacaaaaacaaacaaacaaaaaaaacacaaatcccctaaagccattgagtttggagagatgaaggggataccaatcctctcttgaaaagccactaatggatttgatccaaaacaagtcaaagttcaagctagtgttcccattagaaagaaaagagtctcttcttctttgaatgctggccattgtcgctgttagaagtcaaagtagagacagagcaagagctttgccttgcttgtgtcctcggtccttattctgatccaagtggtcaacagaccacccagtcacaaacacagccctaggtatccaggatttgccaactagcacatggtaccctcccaggaatgttctggaaaagaaaagaattctaaatccaacagaggaataagcagttaccttcttattgagtttcagccaggtggagaaacctttagtgtcctggtactgcagaccaaagaaccaaacttccctcaagccaatagttttcaccacctagaagagaaaaccaaaacaaccaaccattgattgaatacttcctctgtgtgaggcacagaggacacaaagtttgaagtcaatattatatctgcccttaaagggtttaaggtgctcagcatctggcaagaaaatatacttgagcagcaatcaagaactgatgtcggcatctctctgcacaaagtactgctgaggcaggaaagggatctattacttatgagcactgacacataccaagaaccttacatccatcatctcctttaattttcataatacccctatgctagacttacaattaggcccattttatagatatcaaaaatgaggttcaaataaatgaaataacttgcccaagtttcaggttgtgagtgacagaattagggttcaaaccaggtctgtttgactccaaatccatgcatatccagtgatttctgccacctcctccttccctctacaatgtcacaccacttcccacttccatgatggattaaaggctgaaggtggagattgttggattaactcctgtatcttgttctcttgggccactcccatatattgtccttcatccttagcaactgggggtaatacccacacccttaagactgagttccatttacaataccccaaataaagaatgtttgagaagataaaacggggattgtgaaggactctgaagccatgctgtgcctgggttctgagaggattttttccaaccctgatcagagccaagtcatgattcctcttacacaggtttagggtggaaatgagggtagaaatagggtaagtacctcagtgtagcagctgaggtgccccctgttgtcctgagcctcctggctgaacagtgggcaggaaaaggaggcttgccaagagaacacagatgagctctgttctctagtccctgacattagcatgttaatagtctggccctcagctcaaccccagcatacccaccactgtcgatggcagcagtgaagctgagccacatcctaatgaggtcaggctggccttaggcagtcttttttattttgttttttgggagaaggatgcaagtggagggtaagggtaaggtgagaaagaatcatagaaatatacctggagatggaagcagggaacaaggacccagttttgctgatgtccttcccttatgaacaaattaatatctcccttcaaaatacacacacacacatgcacacacacactcactcacaaagacacacatacacacactaacactgtatccacaaagtttctattatgcatccaaagtcaggccccacagtcacacccagagtttacaatctagagcttcagagaccccaaagaaaaaagtagctcatatttattaagcaccaatcatgtgtcaggcgctgaacagtaaacaaccctgtgagatagcaattatacccatattatagatgaggaactaaggcttagagaggtaatgcatctaaaattacagagccatatagaaccatgatgtgtctgactatagagcttgtaccttttcttctctagcatgctatgtcctaatgccaagtactcatatgagcttacgactcctgagcttctcaagtgattaattgccttgtctctcctttggcccaaatttcccatccaggtaataaactttgatcacttctgcatcgagatatgcttcctggcattcccactagacccaagcgacaaccactttggggagaagccatgtcccccaagtcatcgaccttcattgctcaccaggtcacccttccccttcatagcttggatcaagtatcaggaaacctgagcaaaatgttcatgtctgtctccaactagctgtatgatatcaaggtagcatatttcctctctgggcctcgccttccttatctatccaaattggggagtatggcttcaatgatctcttttttctcttaagttctatcattgtactaattacattacaaggttattttgcaaatggttaataaaaacaatcccatttcccagctacctcttgctgatgtggataattagaaacatgtttagaaaagatcagtgggggtgggaggtaatgaggaaagttcaaaaggcttccagaattcaatggccagttgattccctgactctaagtcaataggcagctggaactgccagaaagtttcagatggagaaatgtgaatgcttatgttgaaatgtaatattggctttttgcagaggatgaaggtagtgggtgggcgtgaacagaaaagatttttttaaagcaccttgtatatcatcctagatctaaacagggcccaaggcccaattaacagttctaatcattttccacagggttgcagaagaatagtgtgtccagatgcaattggtgggaaaaggcaagatccaagaaacaatccagctgagagagagagaaaaaaaaagagagagagagagaagacccactgaagatgctgaagagaagaagatggaccatgagggccaggatattaggtcatggggggagaacagacttggaacagaagtagtagagcagtgctatggtttggatgtggtttgtccccaccaaaactcatgttgatgcttcattgccggtgtggcagtgctgggaggtagaatcattaagaggtagtatgtaatgagaggtgtttcagtcatggggacccctgtccctgtgaattacttgaccttttgtcacattatgaaacagcacaaaggccctcaccagaggctgagcaggtgctggtgccatgctcttggactttacagccactacaattaggagacaaataagcctcttttctgtataaagtaactagctccaggtattttattataagaacataaaatgggctgggcgtgttggctcacgcttataatcccagcactttgggaggctgagatgggcagatcatgaggtcaggagatcgagaccatcctgactaacatggtgaaacctggtctctactaaaaatacaaaaaaattagccgggcatggtggtgcgtgcctatagtcccagctactcgggaggctgaggcagaagaatagcttgaacctgggaggtggaggatgcagtgagctgagattgcaccactgcactccagtatgggtgacagaacaagacactgtcaaaaacaaacaaacaaacaaacaaacaaaaacaaaacaaaacaaacataaaatggactcagacaagcagcaactggtctttgcctgtactaacagactaattgtagaggctaagagactccaagactgaaaggaagtgaggtaggcacagactatgcagccagtcccagaaatcccaggagtgagaccgttagcctctttttgcaccacgttgtctgtttcactattgggtgggagtaggggtgtgataagagaaggaggattagccaggtgtggtggctcatgcctataatgccagcactttgggaggccaagacaggtggatcacctgaggtcaggagttcaagaccagcctgaccaacatggtgaaaccccgtctctactaaaaatagaaaattagctgggtgtggtggcacatgcctgtaatcccagctacttgggagactgaggcaggagaatcgcttgaacccaggaagcagaggttgcagtgagccgagatcgcgccattgcactccagcctgggcaacaagagtgaaactctgtctcaaaaaaaaaaaaaagagagagagagagagaaggatcatggtgactaaagtagttctgagatccagagtaactcaggagaagttgggcaaagtaatacctaaagtgatgtcaaaaaaaaaaaaagagagaattcaggctcagtgctggggggagggagggtgatctctctgagcactgtctcttcctttgtgaacataaagaaatcagaaacataaatgttccacttccttaggctctagggcttaaagagatgagtaatatctctcagcctgcactgaagtctcaaagtgagaaattgaggacgtggcgggaaggaaatatggtctgaaatcagaattgaaactgaaaaagaacaaagaacaaaaatggatgactcctgaccccaggctacaaggaaatctctaaggcccatgggggtgctgtgaaccattttatcaggcaactctaaaccccttttccaagccaagtttttcttgcttccagctttgcttccagttgagacctccattccagaggaaagagaaaccttattttcaagtgagagcttagcatctagcttccagttccaggaataacctctgtggctccagtgactagggtccttatcattccactctgagaaatggtcctatccctgaggaaaaagaaaattctttattggctccctttgacccgacagccagcttatcggatctgagccagtatttctcaaagctcccatggaaaaaatccttaagcagcagaaaataatgaatgcatatacccaagggacatagggggtgtggtaggatggggtagggggagataataggtagatggctgtaacccagctataatttctttgaagcctcaggtttaattatttgtgcaaattttatattctactccataaataatgaatttttaaaattattgcaagtaaaattaatgctctagaatactaaaccacattcatctcacagctttgtatccctcctggaacctgccccatacacctaaagaaagtaggacttcagtttttaagacactagcttaagaaactggaggttgtgtattctactcagctccatgactgtggagagttacagggttcaagcaacataaaatggaaaactgaggtgcagtgaaaagaaaagatctgccttggagtacatcctcgttaattatcaggagcttctggaagcaagaaaaaaaaaccctttacctccttttgacatgtggaggcaacctacatctgaggtctgtagaggggagcggagatcaggtcagcttaggagcccagagattctcttcttgaatcccccatgcatttatctgagtaaacaaactagtgatgtcatcagccacttcaaaagcccagaaattctcttcttgaatcccccatgcatttatctgagtaaacaaactagtgatgtcatcagccacttcaaaagcccagagcatggccgggcgcagtggctcatcctgtaatcccagcattttgggaggctggggcggggcagatcttttgagctcaggagttcgagaccagcccaggcaacatggtgagaccccatctctactaaaaatacaaaaagatagctggtgtgggcacctgtggtcccagctacttggaaggctgaagtgggaggatcacttgagactgtggggtgcgaaggttgcagtgagatcacaccactgcactccagcctgggtgacggagcgagaccttgtctccaaacacacacacacacacacacacacacacacacacacacgagcgtgcacgcctagaggagaatgagggagtaatgctggagccacaagagaagaactgtgtgagaaacaatgtgcaaaactgcatcaatgcccaaacacctgagacccccaagataccattacagatttggcagcatctgcatcagccacccacctgaaagcaaattattgcaccactggaaagcaccaagatgggctaccactattgctgtttctgttattacacattgcctgtggtcaagtggtcacctgctctataacagagaacatactcagctgaggttctaagtttctttcttttatcgttttttgtttgtttgtttagagatagggtcttgctgttaaccaagctggagtgcagtggtgcaatcatagctcactgtaaccttgaactcctggactcaagtgattctccagccccagccacccaagtagctaggactacaggcatgcaccaccatgcccagctaatttttaagtttttgtagagatggggtctcgctatgttgcccaggctggtctgaagctcctagcctcaagtgatcctctcaccttggactcccaaagcactaggattacaggcatgagccaccatgcccaacctagctagggttctaagttttggaagcaggtaaagtggaagaaggttccagaggacagttgatcaaaagcattagaaaaactggaaatgctatgtgccctggtttaagccccagctataccacttcctagctatatgaccttaaacagataatttcacctctgtaagcctcagttcctcatctgtaagatggagatcctcctactataatatatgttagttattttataaaatgaaaaaaaaaaaggtttactgtccttattgcagagtattcaagtcctaagtactttactgagccagaagaacttcctgatttcatagctccctcatctgaactctcagggcaatgccacctactttagtccttaataagaaccaccaatattagaatgcttggtatgcaccaggcattttacttatttgaggattaaatcacaaaatctgagattagcatgattatcattttacaaaggaaaggaaagtactgagaggctaaatgagccatccaaggtcacacagcgaagtaacaggacagaatttgaactcagggctggttctaaatcctatgctttatatatcaccccatggaacctgacctcaagggcgtttatttctttctttgtgggtagagagttgcatgtgcctttctatgcttttataggtaaggaactccaagttcctgaagaacagagatggtgttcgacagtgtagaccttcagtcaatattaaatgaatcagtaaatagatgaatgaatcgatgctttgagatttcacctctgtccttgagcacagccctttagtggcacctaggtaatccaagatcaaaagctttagaagttgaagcaagtgacaaaatcactatagcaaaacatgttctctctcccctctagctgtagcacactcacaagaagagaggtaaatgagacaaactatgagtcctacttccctttcccaccaggccctagacttcctcaagctatggcatcccattgttgcctattatttattgctggtgccaaggagtacttcctctctggttggcttcctctctggtcattggccagatgactgctgcgttccaggatggccataaagcttttgccaattcctgccaaggagtctagctccttcctcccaggcccaggctctaccaggagggcctccttgaatgatgggtcccaagagccagacagaacggacttcctcccttatgcctcatcaagttagagagagaagagctcacatcccccaaatgcctatgaacacataactctactgattcctgacctgacctgccttggcctcaagagggccaaatgctcaattccttgagttcaaatctttttccctgtattttctcacctgtggggtccacctctgtccctctgactcacagaatgtgactgcccccctccttcttatgatagtccttcagaggtctgaagacagaaagcatatcttccttgagtcttctctaagttgaatactcccaatcaccccaaacagagtagtgcagtgcaggaaaagtatagttttgtgatcagagttgtattcaaaattccatatcacaacttactaactacatgacctagagtatgttctttcacctcacagaggcaggagcattgtgaggattaaagcgcctagccaggaataggccatagtatgtgctcaataaatgatacttctcaagataacaatgatgagaagtcatggacttcttggtttccaagtctcccaaaggctttgttttggaagcagtagcattcagaactagcataccaatctgcccagggttccctactatctggggttccctactatctggacttccctcaaatccacacccacagcacacaaaccaaaccaacactaacaaaaaactaccaggcattgaggttttttgaagttaataaacctctttgttcaagaatttttctgcccccactaggctccaaatcatgccttcctcatcctccacagccatccccctgcaatgcacatatacaaagcccccagtgttgagggtagaggatggcgtcatctggtttgggatggggaattagtagaatcagggctcttggaaggagtataggtaaatgtcaaaggagcctctggctcccagctggtctgtaaaatctgcactgactaaccgcttccctctctaatagctgctacccagaatgatactgctgtctaaagcaaagggcccaaaagcctatgtgttctatggacacttcctcccttttgtcttagagacagtaaaaagcctgtcaaggaagagatgatccccctgccagctagccctacctcctcacatatgccagcagctgatcatactcaggtgaggcatttctctcctttttacagaaaaggattgtctgaaatcccaatactaggaacagaaatgggagagaaagagagatggaatgcacaaataaatgccagagataaattttctgagagataaccagatttgagaaacaagttaggcattgtacagatgagaaactgaggcccaaataagggaaacgtttgtatcacagcgaattagtgatagagccaaccctacagcccaagattcatgactttctatccaggcccttttgacttcactaggctgtccctttaaaagttctccaatataacctccatgtgaagagagaatgcaaagcacaattataattagaatgcatttagtcattccagactagcaccataatcacttgtgagctatgtgaatgtaagcacatcactttaattgtagtaaacttgtatttaaatattcctcagactaatttgtattttcaccaattaagtatcaatgattacactttgccattcaaagtaaaacaaacacaaaacaaactccagagaagtaagttccacctaaatctgaagttagatattctgaggatcattaagcccatctcccaattctcccaattctagattatttttctttactttttttttttttttttagagacagagtcttgctctgtcacctaggctggagtacagtggcgtgatcatagctcactgtaaccttgaactcctgggcttgagcaaccctcctggcacaatctcctgagtagctgggactataggtgtgcaccaccatgccatgctaatttttaaattttttgtagagacagggtctcgctgtgttacccaggctggtctcgagcccctgggctcaagcaatcctcccatctcagtgttaggattacagacatgagccaccacatcacgtcaactccagctcaattaataatacaagaagcacaatggtattggaaagggagctatcatttattacttctctaccatatgctggatgctttcttccagctaacactttctttcctatttgtgttttcttatctttctcacctatttcgaatttatctttttggattggacatccttatatgccactataatcagatttttgagtaacaggtaagatacaaaacataacacactcacaaaaatcctgtgaggtaagtattagatatttctcggggggaggggatgaagataccaacccagagagttcaataattttcccagggtctaactaggaaaatgaggattttgtgtcctcatctgtaaaacatgcccatactaattcatgcactcacagagctttgtgatagtcaaatgcttatcataatacttagcatacactgagtcctggataaatgttaactctcatctgtattagccacagacaataattttcccactctatgtaataagaactcagaaggtgtacccaagctgtcctcaaatttctagccctctcctacccctgtctccattctactcttgtcttttctctcaccagtcagaagtattcacaggaatagaattagcttatttgaacactacctccttctttttttcttcctctctccaaccctggggaagttctcatatggtagaaggacacagagagcaaggaagaaagggaagcaagagggcctggagaatccatcagggtgatatgcagcctaacatcctggacaataactcagacctccacttcatcggagtctggtggagaaataggataatggcctgtctggtgaggtcccagcctctggaaatgggagcctcatttttgctcctagaagtctggccacagacggcacattcccttgaatgctaaaaatgtctgtagctgccatctgtttattatagtatacagtacatcctttctgacaataatgattcacaatgaagggacaccccttgggttggagatgggaatgacctcttcactatggcgagtaagcaattatcttcatggcatgcctgtaggagatgaagcagcctcctactgcatccatcaactcccatgttgtcctaagtcccaacattcttttgagagaaatgtgcatagagcttactacctcagggagagtaagttagtttccttctactaggaagcaaaaacatgggacagaggcagtgtggtgcagtggcaacaatgtggagtgcaaatcccagccaaatatcatttgggtgcaattaagttatttaacttctgagcctcatcattaaaatggagaagacatcacttacatgtttcagagttaaaaggaaggctccatatgctaagatttttaaagcatctagcatagaatatacaccattttcttttctcccttattcaggaccaaagataaaattaatcaggaccatagggtgcaggctgccaaagtttaactttgcctcctttcatattaagtctggaatcagccttcattttgatctatcttggagtgaacaggaagagagattctttgacaagaggcaaaagtcatggattgttggcattgtggtggaagctattcagagaaggagaggaggctaaggagtctccgccttacctggtcaaatagctgcttcccggtggtgttgggctggatggcaaactccagctctgcatccatggtggtcacacgcacactgatctaggatgagatcaaaggaagcaggttagtcatctggctctgtgttcaacagagcctgagacaagtgtctctgctcaaccacagaggaaggagttaggatgctaagagcctgggcaacttagatactgatggggatgaagggagaatattgacccaaacacaacccctgctcccaagcagcttattgaagacaaacaacacagccacagagcaatacttaccaaagaacagacaagcatgaaggccgggtgcaatgcctcatgcctgtaatcccagcactttgggaggccgaggtgggtggattgcttgaggccaggagttcgagaccagcctgggtaacatggcaaaaccccatctctactaaaaatacaaaaattatccgggcatggtggtgcacacctgtagttcaagctacttgggaggctggggtatgagaatcactggaacccagaaggtagaggttgcagtgagccgagatcacaccactgcactccaacctgggcaacagagcgagactttgtctcaaaaaaatttttaaaaaagaatgcagatcagcctacaactaagagcaggcaaatgataactgtacttcttccaggaaggcctttccatctatactagacagcttcatctcacagggttctcttctcacctctgatctacctggattatctatagcactggtaaacaattgcagaggcaaattaatatcaggacaaagagcactgggttccacatgataatctaaagggcagaaaaagctttcaataaaatctaacaccccttcatgttaaaagttctcaataaactaggtattgaaggagcatacctcaaaataataagagccatctgataaagccacaaccaacatcatactgaatgcgccaaagctggaagcattcccttttaaaaccgacacaagacaagaatgccctctctcaccactcatattcaacatagtattagaagtcctggccagagcaatcagaccagagaaagaaatagagggcaaccaagcaagaggagaggaagtcaaactatccttgtttgcagatgacatgatcctatatctagaaaatccaatagtctcggcccaaaagctccttaatctgataaataacttcagcaaagtctcagtgtacaaaaatcaacatacaaaagtcactagcattcgtatacaccaacaacagtcaagccaagagccaaatcaggaaggcaatcccattcagaactgccacaaaagaataaatatctaggaatactgttaactagggaagcgaaagatctctacaagaagaactacaaatcactgctcaaagaaatcagatatgacacaaacaaatggagaaacagtccatgctcatgaataggaagaatcaatattgttaaaatggtgatactgcccaaagcaattcatagaatagactcaatgctattcctatcaaactaccaatgacattcttcacagaactaggaaaaactattttaaaattcatatggaaacaaaaaaacagcctgaataaccatggcaatcctaagcaaaaagaacaaagctggaggcatcatgctacccaacttcaaatgatactagagggctccagtaaccaaaacagcattgtactggtacaaaaacagacacagagaccaatggagcagaatagagagcccagaaataaggccacacacctacaaccatctgatctttgacaaagtcgacaaaaacaagcaatggaaaaaggactcccaattcaataaacagtgctgggataactggttagccatatgtagaagattgaaactggaccccatccttatctcacatataaaaatcaactctatatgtattaaagacttaaatgtaaaagtaatgtaaaactcaaaattataaaaaccctcaaagaaaacctacgtaataccattctgaacataggaatggacaaagatttcataacaaagacgccaaaagcaattgcaacaaaagcaaaaattgacaaatgagatctaactaaactaaagagcttctgcacagcaaaagaaactatcgagttaacaggcaacctacggaaccagagaaaatatttgcaaactatgcaacttacaaaggtctaatatccagcatctataaggaactttaacaaatttacaagaaaaaaaacaaccccattaaaatgtgagcaaaggatatgaagagacacttttcaaaagaagacatacatgtggccaagaagcatatataaaaaatttacatcattagagaaatgcaaatcaaaaccacaatgagataccatctcacacaagtcagaatagctattattaaaaaatcaaaaaaaaataataacagatgctagtgagattgcaaagaaaagggaacctttatacactgttggtgggagtgtaaattagttcaaccatggtagaaaacagtgtggcaatttctcaaagacctgaaaacaaaactaccattcaacccagcaatatcattatggggtatatatccaaaggaatataaatcattctatcataaaaatacataaacgcgcatgtgcattgaagcactattcacaatagcaatgacatggaatcaacctaaatgccagtcaatggtagactggataaagaaaatgtatgttagtatgcagccataaaaaacaacaagatcatgtcctttgcaggaacatgaatggagtggaggtcattatccttagcaaactaatgcaggaacagaaaatcaaatgccagactgggcatggtagctcacacctgtaatcccagcactttgggaggccaagatggacgcatcccttgaggccaggagttcaagaccagcctggacaatatagcgaaaccccatctctactaaaaacacaaaaattagccaggcaaggtggtgcacacctgtaatcccagctactttggtggctgaggcacgagaatcgctttaacccgggaggcagaggttgtagaataccacatgttctcacttataagtgggaattaaatgatgagaacacacagacacatagaaggtggagggtgggaggagggagatgatcaggaaaaaatattttaataactaatgggtactaggcttaatacctgggtgataaaatgatctgtacaatgaacccccatgacatgagtttaccttatgacaaacctgcacatgtacccctgaacttaaaataaaaattaaaaacaaagaagaacactggattccaagcctagcatgtagctggtcaaatctacaaccttggataactcctgtccttttcctgggccttagtttcccttacctgtgcaaaggcaggaatgggatggagggcagccaattaaactagataaatggtccaaagaccatttcagtgctgatgtcggtggttctatatactgccttgcattgctaatgcttcctatatttatgtctcattggcttccttaggctcaagaggggaagggggcctcagtagaggtgggtatgggtggcatagaggggctaccaaagccaactcagtgggaggacaaaggtgcagaaacaggcccagaccaaaataagagacagccacacacatgatttcacgggcactagaaaaaataccacctttacaaatagatcctcgaagctaggtcaatgatagctgaaatttcataattagagatttagtcctttggctgaaaactcagtagtaatggtagcagtagtaatagtaacaggcagcagctttcctgtatcaagacttgctactcaccaggcacttcatatgtactacctcatttaatatcaataatcaccctgtgaagtagagtattatctccacattggagataaagaaataggtatttgtctaaagtcacattgctattaagcaggggagacagggtttgaatccaggtctaaatccaaacctcacaatgtaaaccaatatgctaaattcctcttacagagtacaaaagtctcccattaaaagaaaaaaaagattgatttttagttgttagatattttgcttaaataatgtatatagtacagccacaaaatggcttcttatatggtcatacaaaatctttatgaagactatttcatgctcacggaagacactttagtaatattgaggaaatgtaaacagtatttcatagagtccgtgagctcaactttgtaaaatgtatacatagaaggatgattggaatcttgtccaagtattagtcaggcttggttttggggtggtgatcttatgggtgctttctcctttctttaaactaaaaaaaaaaaaaaaaaatctaatctacattttctaagttggtcacatactgcttatagtattgagggaaagcactagatatagtattgccaaagatgcaaatttccatggagtgagtaagacattaaaccttatcagtctttgaacctctaggactttcctgaacacacgggtcaggagcagggaagagggggccaggcagctattttgccagataaacaattacgatgaggatcaggcccagaaaacaactttgtaaataaatctcgctagggagccaaggaggaaatctattttaggattgacaatgggacaggaaaggccctgaaggcaggaacaagtaaggcaagtaccccagtgggagtaaggcaaggttagccactttgatttggtcctaccctaggcttcctgccaagtcagtgacccctacagaatgggccgtcataaagtaggatggggccattggactggaatttgaggggcaccatactatatccagcctcaaatcacccttgagctgggtcaagggtgacctcaaaacaccaatgactgaagggacaggagagaatagaaagggggcagtgggctttttagaataatagacttcattctcaactcaaagtttacgtcttacttagaattacctttccagtactcaagattcaatgggtactcatgcaagatgttggctaaatgaatgggtaccaaacaagggatattggagatagatacagcataatatacacatacaaagatggggaaatttgacatcttgacttttttgtgccacgaatcattcttgcctgtctagtgaagcctatggaccccttcttagaatatttgtaaatgcatgaaataaagtagatacaatataacaaaattatatcgaaatatttgaaatataaatcaaaatttaataatatgtgcttattatcatattaagtaattaccgagcactaggtcttattagttagttattgccactgtaatttcaaacgtgtattgagcataaataatattttgagaaatatacaataactaattgtgatataaaaatatgtatgttaggggccgggtatggtgtctcacgcctgtaatcccagcactttgggaggccaaggcgggcgaattacttgaggtcaggagttcgagaccagcctggccaacatggtgaaaccccatctctactaaaaatacaaaaattaggccaggcgcggtggctcacgcctgtaatcccagcactttgggaggccgaggcaggtggatcacctgatgtctggagttcaagaccagctgaccaacatggtgaaaccccacctctactaaaaatacaaaaaaattagctgggcgtggtggagcatgcctataatcccagctacttgggaggctgaggtcggagaatcccttgaacctgggaggcggaggttgcagcaagttgacatcgcgtcattgcactccagcctgggcaaaaagagcaaaactccatctcaaaaaaataataataatacaaaaattagccgggcatggtggtgcacgcctgtagtcccagctactctggaggctgaggcaggagaatcgcttgaacccaggaggcagaggctgcagtgagccaagatcacgtcactgcactccagcctgggcaaaaagagcaaaactccatctcaaaaaaataataataatacaaaaattagccaggcatggtggtgcacgcctgtagtcccagctactctggaggctgaggcaggagaatcgcttgaacccaggaggcagaggctgcagtgagccgagatcacgtcactgcactccagcctgggtgacagagcaagacttcatctaaaaaaaaaagtacattagatagtttctgtataaacttctattattaagaaaccttaaaaaaagggtagaatccaggaaaacactccacagcctaagagttggtaacaaggtcatgggtactgctattattgctgcctttattttatttttatttttatttttatttgcctacattataattgaacaaatggctaaattacaaaggagaggttggtaaaaaacaaataagtaattttcctccatccaagttcatatatccttcccacttcaaattctgtccatggaccccatagaggtctgaggaccccaggttaaggagcttcctataaattcatttcaattcacccaatattaatggaacacaatgtttaaggaactatggttggaacagaccagtagaaccggtccctgatctcaaggcacttactgaaaaacacaaaaactaaaatgtacaagggagaccctgaaaagtgccataatagaagaacagagaaaacctttcgtggaaattaggaaccacagttcaaagtagtgtttgcactgatttccaaagaataagctggattgtggaaaagaaagactgtgagggtaggcacaagagcactcaaatgtcccaggtagagaaaacaacatgtatgatggcccagaaggaggcaaggatgcagatggtccctttagaagtcagtcctactccagggtgaatgaggcctgcaaagtgaagagagggcagagtctaggaagataagtggagggcattgaaggctatgctagaaggttgggccttaatcctgttggcagtggccagccagtctagaggttctgggcagggtggggcacaatcagaaccaggctttttggaagaaaacacccaggaaggaaactaagggggggtgggattccagggacatatcctaaagcctaggagttccctttaattcacaatattggaaataattttcaaaggaagcaagccagtgtctcgaacagatcatgtcaattgtaggtcatgccaatccagcgtcttcagggcactgatcaagggtgaagcccagtgctggcccaaagtacgtaatcaaatattcgttaaacaaatatttattaaataaatcaattggtaaagaagggcccatcctgagtgatgaataagcatgtcagagaggctagggttggccatgcttcctccctcgtagaggatcaccctggtaaaagggctctactaaaatcagaaggtgtgagctgaaacccaaccagaacctgttttttctgaatctctactcagggtttctgccattccactatggcttcttccccagggatagcagcctgaggtttcctgaacttcaatgtggagataaataattttgggtttttaaaaagttggaaagaaaaacaaacacaaaagaattcccattcctgtctccacttaactcagaagcaaatgtgagtcctgttagcagcactgtaaaccagtacaaccactgtggacaacagtatggaggtttctcagaaaactaaaaataggactaccatatgatccagcaatcccactactagccatttatttatccaaaggaaaaaaaatcagtatatccaagagatatctgcaccctcgtgtttactgcatcactacatcacaatagccaagatatggaatcaacccaagtgtccaaaaccagatgaatggataaggaaaatgtggcatatatacataatggaatattattcagccataaaaaatgaaatcctggccaggcacagtggctcatgcctgtaatcccaacactttgggtggctgagatgggcagatcacctgaagtcaggagttcaagaccagcctggccaacacagcaaaaccccgtctctactaaaactacaaaaattagccaggtgtgatggcgtgtgcctgtaatcccagctactcaggaggctgaggcaggagaatctcttgaacccgagaggcggaggttgcagtgagccaagatcatgccactgcactccagcctgggcaacagagcaagactccgtctcaaaataaataaataaataaataaaaatcctgtcatttgcagcaacatggatgagcctgaaggacattatgttaagtgaaataagccaggcacagaaagttaaacaccccgccaagcacggtggctcacacctgtaatccccgcactttgagaggccaatgtgggcggatcacctgaggtcaggagttcaagaccagcttggccaacatggcaaaaccccatctctactaaaaatacaaaaattagctgggcatggtggcacacacctgtaatcccagctactcgggaggctgaagcaggagaatcgcttaaacctgggaggcagaggttgcagtgagccaagatcatgccactgcactccagcctgggcaacatagtgagaccctgtctcacaaaaagaaatgataaatgtttgagatggtgagtatgctaattactctgatctgatcactatatattgtatatatcaaaacactgctatgtaccccataaatatgtacaatttatgtatgcatttattatgatgtgtcaggttaaaaaaatcaaaattaggctgggtacagcagctcacacctgtaaatcccaacactttgggagaccaaggtgggaggacagcttgaagccagaagctagagatcatcctgggcaatatagcaagaccatctctatttaaaaaaaaaaatcaagttaaaaaataataaaaattttaaaattaaaaattagaaaaaaactaagtcatgaggacaaggccattggtctatgctctcctgttttctgtgtacgtgtcagaggtagcagggagtaagggtagtaacagctggggcctgaaagtgatagataggatagaagtcctgatcaaagaaggtccctttgttctctcttagattaatcagggattcaagagtgcaagatgggctgcaggcccagacccactgccacagagggcccactggatgctcacccttagtaggcacccatggtcttcttttcgggcctagacgctgctctctccctaaagagaagacagtggtcttgtttgggaggaaagaacctaaaaatgaagtttccaaagttggcagaaaattcccagccagtccttcagtttgacaggaatacaggagctgacccggatggggtagcatttcaagatgtagtccccagaagagaactgtttatatgcctagatccctgcctaagccaggccctgaggatctaggcacagcatgaggttaaagactgtgtctcagaagaacattaaggtttgaaggaacaataacaaaatgtctgcatgtgtgtttggggaaggaggagtgtcatcctctcacatgcactggccctcccacctgttgcccaagaacaataagcccactgttatttactgagcaattcaacatagacgcttcccacaccaagcacttcactaagcacaaacaaactcatctcggtggtacactgtccaaagccttcaacaaactgggttctctctcatgtctccagttagctgggctgagacacaaaagtaaccaggccagatgctacctctgtcttggcaccagcagctgagaggtactttggtgtctgggcctgccagtttcaaataagcaaccctctctttgcctatcatcagaagcacccaggtgagctgtagcccagctacagcaaaagggattagcaatggtttcccctcacctaccccatgtcactgaactataagatggctctttcctggagagaagtttggaagagtcagagagaaaagcagagagtaagtcaaataattacaagtaacttgcctggagcatggacctccgagctgaggggatgaacattaccatccccacttcatagatgagaaaactgaagtgcatagaggcaggtgacagaaggatggaaatgaacacttactgaatgccaacaatgtgtcggcctcatcacacacagtctcacttaacatcactgaggtcacatttactcagccaacaagtagtggaggcgggtcttctggacattcctggagctccttccacaactccacccacctctcctgtcatgttgtcttcagacactggcttggcaactattttggctaagactcaaacattctggcataggaagcctgggcacatctgggaagcactgcttgggaaggtccccttgtctcactggggcagaggttgtgagtcagcccagttgggtctgagctcaatgacctcatttccacctgccacctccccagggggccacccctgctgggctttcagtggggctgctggtgtagagaagaaggcaagtataagtggggcaggggagccagaagaaggatgtgccctaccaacgcaatcccagagttctagtatcttccttggccagagaatagtcatcacagcgtcactcacactgccttcatcaggtcggaagctaaactccattgtttaggctccagttcccaccatttcctgctactaagagtggggccaaggcagggcagggcaggtcctggtctgttttgcctctctggatgacagcactgtctcaactagcttttttccataagagggaaaacaaggtttgctttgaatctttagcctaggggccattctgctcctcctcctcttccttcactgactaactcacttctcagcaagtcagcctcttccctgttgacttggaagtggtaactggtacagttatctgctaggacctcttccagactctcaatacagcccataaaacctgactggggttaacctttcctatgcctgtgccttttcccagtagcttctagaaaggagaacaacacccaacctcactcacaccttaatgggttagcagtatttcttcaaccactccaactgctccagagggcgtcagagacaagggtcccctttcatttgttttgacccagccctgtcatccgaagctcctcaagaagcatttcaactggaagacaagggcacactggaaactgagagttactcctccaattaccatatgtgtgagggttagcaatggaaatataaccaccttgtccctgtgggagcagagttcaggtcagaggtgaaaattgaaagaaaaaaatcagaaacagtgatgtcactttagcaagttagtttcttcgttaatccagccgtaattgcatggccttttgttcaacctcaggcccaggtaaacccctcttgtttttctctccacacgtgaaagtcaggaagaaaaccatctgcttagtgtctgaacctaacttcagttcttactttcaaaatcaccttagccaaaccatacccccagggcaaatactctccagccccaactcatctctccttcttaggcacatgggctgacacaccagctccttagcatggccattcctctttttacattttctcattatttcaacccatgcatcctagaatctcatatggcttctcccttctgaacttcaacttgtcctctaagaaaataaacagtccagaatcccaaactgtcagacctgaaaaagacgtcagagatcactcgattcgaaccttgcaacatacagctggggaaactgaggtccaaagaaaggtaggcactggcccagagccacacagctgctaggcagtgtgggaggaggggctaaaaacctggcttttgaggctgggcgcggtggctcacacttgtaatcccagcactttgggaggccaaggtgggaggatcacctgaggtcaggagttcgagaccagcctgaccaatatggtgacatcctgtttctcctaaaaatacaaaaaattagccaggcatggtgttgtgtgcctgttgtcccagctactagggcggctgagacaggaaaattgcttgaacccgggaagcggagattgcagtgagccaagattgcgccactgcactccagcctgggtgacggagcaagactccatctcaaaaaaaaaaaaaaaacctggcttttgatccactagcctatttagtaagccatagtgccagcctgacatttagaaaacagtagatacttcaagcatactattattgatctaaaaaaaaaactatgtggaggaggctggatcaatttgtttccgtgaaaaactccaagctggcactgcttggaagtttagctttcaacagagggcaggcctaactttcaggatctgagacaatcaccaccacccattctagggagactaaatattttataacaccatggaaggagaactcagagagccctgtttccagaactgttttctttggaaaaacttgaatagcaactggttgggaaggcccccagtaataggcatagccaagactcaagctggggattgaggagggcacagagcagagaaagaggaagggaatttgagtaatgggttcatatccaggcagccaagaacaacagattccttcaactcccataaaacttcaaagctgctgaaataaaagaagtgcagacccatcattaataaagtaagtctccagatgggcaaagcccctatccggggccacacctagctgggcttcactctttagcgtcactttcctgcttgacccagcttcctgccagcaagttttacaggaagtatttgtagactggaaactgaccatttttggctgcctgaatatgccagctctgcccagggtgccagaagagggctctattccctctgcttaggaacagactccagcaacctccagcatcatacttctgaagcacactggagctgatccaaacccaaacttgggttccatctattgctcatgggaatgttaaaactgctgaagccaggattagtcaaatatgcagttgcagggggacgcttctggccctaatcaaaaagctctgtttccagctgagcgtggtggctcatgcctgtaatcccagcactttgggagggtgaggcaagcagaccgcttgagcccagttaaagaccagcctgggcaaaatggcgaaattctgtctctacaaaaagtacaaaaattagctgggcatggtggcgcacgcctgtagtcccagctactaatacttacttaggaggctgaggcatgagaatcgcttgcttcaacacaggaggcagaggttgcagtgagccaaaatcttgccactgcactctatcctgtgcaacagagagagatcctgtcaaaaaaaaacaaaaaacaaaaaacctctgttttcaaccccaggggtaggctaaggttggcttcctacctaccttgctggtaagctaagaaccaaatctagtatctgggaaacccacagaaaacccaggagcccttgtcctggaaataatggtctcagcattttgagctttggagcctttttgaccttcctctttctaaaattcagtttcctaatctataaaacgggtctaataatatcgacctcagtacagggttattgggagatttaagttaacataacagacatgtttgacactggaggaagaaaataattgaacagtaataaaaataaaaataataataataatagacatgaaagtacttgacacatcataagtagaatgtgatgattactaatccctccccttttagccatattatgacgaatatcctacctgtcaggaataatttaaaacaaaaacctgtttcactacagagggctaggggctgcccaagaagacctctaaagagcccttctagcataaaggactctcactttcagggaaaactaaaaggtgattacatttctagttggcaagacaatgtgaaaccatgcacaacagttaaatacacatgtattccagcattattttaaatattttatctcttgagagagatggggatttcctccccaagaagcagaatcctatggaaaggcagagcacaacacagcacctatgctgccttattattttcaaaggctgcctgatcttccttccttattctggactctgccttgccattttctccagttatgtcccattaacacacacaagtctgcaaccctcaacacaacccactgggacctccaaactccctcagatggtatccagaagatcacaaactgtttttgttttgttttgttttgttttgttttagacagagtctcactctgtcacccaggctggagtgcaatggcgtgatcttggctcactgcaacccccgtctcccgggttcaagcaattcccctgcttcagcctcccaagtagctgcaattacaggcacccaccactatgtctggctaatttttgtatttttagtagagaaggggtttcaccctgttgtccaggctggtcttgaactcctggccttaagtgattcgaccgcctttgcctcccaaagtgctgcgattacaggcgtgagccaccacgcctggcctgggatggtgttaatatgactagagggatgtctgatagaagggaaacacagcaagtaaagagcaactgaaaggccgggtgcggtggctcacgcctgtaatcccaacactttgggaggccaaggcgggcagatcacttgaggccaggagttcaagaccagcctggccaacatggtgaaaccccgtctctactaaaaatacaaaaattagccaggtgtagcggtgcattcttgtagtcccagctacttgggaggctgaggaaggagaatcgcttgaacccgggaggcagaggttgcagtgagccgagattgcaccactgtcctgcagcatgggcgacaggcgacagaggaagactccgtctcaaaaaaaaaaaaaaaagccaattgaatacggtccacatccacaaaagatcaaggatgcaaggatgcagtcagttctgctactgccctcaaatccctctgcaccttggcctccctatttgtaaagtagtgcagggattatccctgctcctccctacctaaaatcatcactacacaccatcacatacaccactgtgcactaaagtaatgtctctgtagtaagaggaacatagctttgtattctgaaaacctgatctcaagatccaggtctaccaataataaaccatgaactcttaaatttcaacttgtaacgtgggcataatgatgccaccatggcaggagtgttgtgcagtgcttaatgaggtatatcccaaacttagcttaccataagaatttggcactggtcaaaaagtccagacttctggacaccaccccaagcttactgaaatggactctccagagaagacgctggggaattagcattttaacaaatgcctcaggtgattctttccatctgaaaagttcaaagaaacaacacatggccttgatgctgttgaaatgagagaacaggaccagggatctctggtcatccaaaatgctttctggcccagagatccccatgacaggaaccttgaggttagcacccagcaaagtaaggtctgcaggcaggaagaggaggagactttgaaattacaatcagaacgctaagtgcaccagaccctcagaccattgtccaggatcttcaaccatcctcccatctagctaagaatcaaacagtgggagaaaacagacagttcagatacttcagcagccaaagcatgatgatcacaatgctataattagggccccactcaaagccctcttgagttctctgcgtcttaaacactccacattcactctttcctggaagaactttcaggcaaggagcagaccttaaatgaagctctctctttccttgatgctcttggaacttgaggaaaagaagaggcatggttgagaggatgctgcatttgcatacagatgtgagtatgttggagggtgagggtaggagtctaaaataggtgtgactagcaatggtgcactagaaccagcttgcactagagctgatcatgcacatctcttcccaactcctccatcaaggactgcatattggtaacctgaaatcagccatggtgggagtatttataccatgggaattggcaaacagtaaaaatcatggatttgccgaagagttgattgttaaacatttaccagcacactggacaagagacacatgcaagttaagcattattaaacccattttatgaatgaggaaactgagtctcaaagaaaggaaccaactgctattttctagctgcatgaccttgaccaagagccaagtctgtctggctagctataaatccctggctctccttaccagcaccccagggtagcaggacatccttactatcagccaaaaggtggctgacccaaagggctccccatcagctaaaggccaaacaagggcacctaattgtgcccagtgcactccaaggaaatctgaggataaagagttcaggactgagacatgaagccaacaagagacagtctcatccccaccagaggagagaggctggagtgaggcagggagtgggctagaaaaccccaatagaaaccataggacattcttaagatctcttcacaaatacctgacagaaaccctgggctctagaggtagtctctggaacattacaagtccctagacctcttaaagcctcagttttcctacaggtaaaatgggagtaataatgcctacctcaccggagtgttgcaaggctgacattttatcctttacaaacagaaaagcacctggcttggtacctggcatgtagtagatgtttcataaattttagttcctttctcctgcaatgccattatccaacccagattcttccagggtctctggctcacttgtatacaacaataatcctagccccatgcgcacagtgctctacaatttaaaagatacttgcccatatgcattctctcactgaattaaaccctgtaagaaaaagacaagcccgagacaagtaccattttaaagaagggagaaatggaggttcagtaaggtaaaaagcaacatgctcaagtgtgaaagaaatagaactagaaccctgatctccccaactactagtattctgttctttacctttccaagtttatcttatttaaggctacacaaaggtccttccaaaggcttgcctattatcatttgtctttttttttttttttttttttttgaaacagattctcgctctgttgcccaggctggagtgcagtggcaccatctcggctcactgcaagctccgcctcctgggttcacgccattctcctgcctcagccttccgagtagctgggactacaggcgcccaccaccacacccagctatttttttttatttttagtagagacggtgtttcactgtgttagccaggatggtctcgatctcccgacctcgtgatccacccgcctcggcctcccaaagtgctgggattacaggcgtgagccaccgctcctggcttatcatttgtttcatccaagaaattgagcagcctctggacttcaggtctgtcttaggatgctacaaaagaggctgtctttgggaaaggagaatagcattggtaacacagggtgggaacagcccttgtggtagaaggagccacatctttagctcggagcaaccagccatgaatggtggttcagagattgggtctctgagtccaatcccagtaaacttcggatatttacttccccctgtaggtctgagtgttcccaactgtaatggctgggttttgctcagtggttttgactttattacatttctaacagcttcctgcctcctcaatctcccaaacagaaaatcacacaaaacttcaaaatatgaagtacgtaaaagtagagctgttctggttgaagggaggctgtagctcaccaggtagcccagccaaacagtttgtaacccactggattagcagcttgacgggagggagagagccctaggtctgaccttctagaattctactcatcctagctttgccactgattccttataggacttatatgactttctgggcttcagtttccccatctgtaatgtgaagtggttggtctagttggcctctaaaggtcctttcagcattgcgatttcaggaaaaaagtgtccagctattcccacagtagaaaactgtggagagagaccagcatgagcaaaggtcaatctctactctgaagaaagcccttcaggctctggtgactctgaactgaactcttcaggcaattcctcaagcactgggtgggtgggcagacaggcaggaaggccggcgccccaccctcttttgcacaggaagctagctacatcctcttttccccaccccaggcagaacatcaccacaggtccccagcagaagcagtggggggcagggagaagagaaggatggggcctgaaaggaagttgaacatgcaaatcacctcagctaaggagccatttgtggggagggaaacaactggggccctgagaaagagcagcaaagctgcccattatctactggggcccagctccccaataaagcttagcaaaagtggcctgaagccacaggctgtcataaagaatcacaaggcatgggttggtacagtgagcagcctgggcccactcactccacctcactgagtttctgcaagccaaacagctggggctcttacacaaggtgtttctcaggtacagtctttcttagggtaagaacacagacatgccatgtgcgagggtggggtgtacacatgagtgaacaatcaagaatacaggagctcttcatgcctctcaaagccaagaaggcaagcactaatcctcatggccttaccaccagcccattttccggtgcccacccccataccctgtgactggggcccagccctccccacatcctgttctcagagaacacgcggctgcctaaggaaagataatgtcattaccatacctcccctccatagaggaggctttggttgactggggagggagctgcagttttctgtctgaccagactgaataatctacagtaaatctcccagtttcacagaatggaacaggaagggtaactaggtaacactaggagcaacttctaaattggaggatccatgcctacagatagatgatcatgattcaaagcacttctggaaaaagaaattttctggaaaaacacaaattgacaatttaacttacatttggagactggaagatgacatgccaatgttcttccttgattaacaaaccaggaaatgcaaaaatacaataaaattacagttttaaaaaggtcccaaatgtcaatcaagtctcactacacatgggttttagatgccagcattggtatttctgctaaagcaccctgatttaaatgtgcctacagtggctttggccactttgaaaaagaaaatgatctcaggccataggaaggtcccctgacaaactcaaagaggaaggggcagtgaggaggaaccacagcctgaacctacccattgttgaaacttccttctctcctctctaaacagctcggactccctggctcccccttgtcttccctccccaccctataaatatagcaaagaatgtggctgaacatccatctgaatattcagggagagcctccttactcacgtaagaagttggaaggcagatgtcattccacagcactgcctcactactgtgcagaccttcaatgtggcatgatccttggttgggcttgtatgggggactttggctggctacccctaagcaggatgtccccaaccccccacccagcctgctgttcccctaggctaatcttacagcctaatccaattctcatccccattagggaacaaggtttatcacgtaggccttaagaaaaaattttttgagagtagtctcaaaaatacctacctccagtggatgtgctgaaggttgaaaggtggcctcataacctgctgcaagtgtatttgtttacagccattagctcacagccttcatttttgtatgaccgccttcctggaagcagaggttcagagagcccaaagaatgctcttgggctgtatggatctatgattgttttggaagagtctcttggtggcaaggataagataagagaccacatggcatccagcttattagttttggtccctatgtagcttgaggtaacttctctaaaagctggctttgttttttcgagttgataaagccacatctttccctccaaaccacaagctcagctaacaatttactgagactagtaaaaactatttaacctatcctgcaataatacaagggtttttagcacccctaccaccacaaacatataaccttcacacccctcaatgctgaggtgagcgagcatgaacctatctagccccccacacacatattcatatcagttctttggagagaataagaatcctacccccagccccgaatgtttggtctagttttttcagacaacagtaaagaggccaaccagaatctctatggaaattacccagaagcctccctaatggtcaaggcaacatacattgttccataatccaaagcaaaccctaaaaatctactattctagcaagatctggaaaaacaagtaaggctacctcttacctacctcaggtgtttcagaaagaacccacatcattgacacagacatatgtatacacatacaggttctacataccaccactttatcagacacccaatatggatcggatcaggctttgaaataattcgtgtgtgtgtgtgtgtgtgtgtgtgtgaatgagcaagcacgtgagggcatttttttgtcagatggaggaaatatgcagataaatggatgagaaattaccattctatacagcaagggcagagatagaggtaattaaagtggactgtggaaacacaagcaagaggcatccaggccataatggggaaggtgaggagacaaggggaggtgagaaggcagaaggttgcttgagatagagctgacctctcctgaaggacaaaggagactgtcacaagaaaaagattaaagggaaaaggaacctcatggtattctgggtagagagacagcatgtacagggatacagaggtaagaaacacaaagtatgcctttctctcaaaggcatgaagttaaatatcagtgtctcctttcccagcttcctgaccctcttcccagaatttatcagaagaaaatgaattaaagatcttcccaccactttggcattaggtgccagctcatagatttgggggagatgggccacaatcagagacagaaatccctgaagacaaagccaggcaagatagactaatgtataaaataaagataagaagctgattatgttcccacagccccactgaggcaccagcttagcttaatgagcactccccaccctagctcacacagacctcagaggaatcactcttcaggacttgagggagcccatgacaacatactttctttctttgtttttttttttttttttttttttttttgagacagagttttgtcttgtagcccagcctggagtgcaatggcacgatctcatgatctcggctaactgcaacttccacctcccaggttcaagctattctcatgcctcagcaacccaagtagctgggatcacaggcatgtgccaccacgcatggctaattttgtatttttagtagagacggggtttcaccatgttgatcaggctggtctcgaactcctgacctcaggttatccacccacctcagcctcccaaagtgctgggattacaggcgtgagccaacacgcccggcccgacaacatactttcaatacacatggataacctgcctacctacagatagacctggaaaggcaaccaaactaagatccctctgcatctatactccaccaccaccaccaccacacacacacacacacacacacacacacgcagacacacacacacacaaagaagaagtgaaagctaccagcataacaagggcctgaggtgggccccagccaaggctgcctggcttctgcaaaggggtggagatccattgatttcacaaactgttttgccttcttaagtaaggattcctctaatcattttctccttcctacatcctccattcttcacaccccataaccatcctttctaccctgggtctcatgtccctcttctccttttctactactccctcatcctgggacttttaaggcttcccagagctggagttcctctttacaaagtgatagatacacccacatggattctcagacaaccgttccctccaacagattgcagcagaaggcacgatgggtttcaccacaaactaggccagtcattggcatcactgtttgaagtatcagtttcctcatctattaaaacaaaaccgtaaagagtgccgggcgtggtggctcacgcctgtaatcccagcacttttggaggctgaggcgggtggattacttgaggccaggagttccagaactagcctggacaacatggtgaaaccccatctctactaaaatacaaaaattagccgggcgtggtggtgcatgcctctagtcccagctcctcgggaggctgagacagggaatcgctggaacctgggaggcaaaggctgcagtgagcggagatcgtgccactgcattccagcctgggcgacagacagagactccgtctcaaaaaaaaaaaaaaatcttaaagagataatgtagtataggaggcacactcacaaattaaaagcagacttcagggttctaaaattatttgatctcaaatccttaaagagggcaaagtatgatggaaaagacttagggaactcagccatttatcaagcactttcaatatgccaggtactctcctagatatactcatactcttgagctcttttaactctcataaatctcagtgaagtaggtatcagtactatcctccgttttgttttttttttttgttttttgtttgtgtgtttgtttgagatggagtcttgctctgtcacccaggctgtagtgcagtggtgcgatcttggctcactgcaacctccgcctcctgggttcaagcgattctcctgcctcagcctcccgaatagctgggaatacaggcacatgccaccatgcccggctaattttttgtatttttagtagagacggggtttcaccgtgttagccaggatggtctggatctcctgacctcgtgatctgcccgcctcggcctcccaaagtgctgggattacaggcgtgagccactgcgcccggcccactatcctccattttaaagatggggaaactaaggttgagagacattaaatacattacccaaagtcatgcagcaataaataatggttaaaatgattctaatatttggtctgtcatttatcttataactaccaccctcctttctcttgaatcaacttgagcaatgttgatgagactctaggccccccaaaaaaatcgcaggaagacctgaggcaactctacttaggatgctcaccattaattatcacctgaaaaccatttaagccaacctcactcattgactactcataaatattctttagtccctaaagggaaatttatagcactaaatgcccacaagagaaagcaggaaagatctaaaattgacaccctaacatcacaattaaaagaactagagaagcaagagcaaacacatcaaaagctagcagaaggcaagaaataactaagatcagtgcagaactgaaggagatagagacacaaaaaacccttcaaaaaatcaatgaacccaggagctgattttttgaaaagtacaattttaattctaaccctaggtgaccacagaccccatgtatacatggaaggagacacaatggtttggttagttagtaaccaacatggaaggtatttatgattggctacaagaagcaggattcaaaggcctgcagtgtgtctggatcaggaaagaggtgactataaagaagccatgagtatataagaaataggtatacaataaattggcagtctaaagcacagactagcagagattggcaaactgtctctgtaagccacttatagtcttggttacatattcttttttcttttttaaaaaaacaacgctggccgaggtgggaggatcacctgaggccaggagttcgagaccagcctagccaatatggcgaaacctcgtatctactaaaaatacaaaaattagctaggagtggtggtgggcgcctgtaatcccagctattcaggaggctgaggcaggagaatcgcttgaacctgggaggcagaagttgcagtgagccgagatcatgccactgcactccagcctgggcaacaagagcaaaactccgtctgaaaacaaaacaaaacaaacaaaaaccaacaaacaaacaaaaaatgtttttaaaatggtaaaacttatttttatgatacatacaaaaactggtccaacaggcaagttcaccaattcctagacttaaccaaatactgataactccactgactatctgcaaggcctcaaacctggataaatatctcttttcacattctactttccaaaaaagatggacagcaaaggttttatctgaaagttagccaaagataactggcccacataccaattgatcatacatagcagcctactcccttcctatgcaaaggcactggcagaaaaaatagataataagcttagaccactaaccatcttccacaaaagctcattccattctcatactaggaaggccctgggccaagctgatccccacaataggaggccccaggccaggggctgagccataaagtacctgactcccaggcctctggctcaaatccctgaccttagagagcaacaggcatgcatgaagaagaaagaagcaagaaggggatccctcccagctggccaattaagggctcaagaagcaaaggaacatgtgtgccttgcttctctccctattccctcagaaaaggtttggagaataaaaggaaatcaagctaaggatgccaaactcaatgggagtgagaggctaagaatgaaagaaggccaccacagagctccacggctaatgacctccattagtggccaacactacactaaggcctttctcctctggactaagtctaggatgttcatgatctgcttggcccttctctcaaaagtggtgggaagaaacaaccattcaggagtgcctaccttctaacctcccaccctggctcttcacaattgttcctcctctagaaaaagaaaagagccgggaacagtggctcacgcctgtaatcccaacactttgggaggctgaggtgggtggattacctaaggccaggtgttcaagaccagcctggccaacatggtgaaaccccatctctactaaaaatacaaaaaattaaccaggcgtggaggcgggcacctggaatcccagctactcgggaggctgaggcagcataatcacttgaacccaggaggcgaaagttgcagtaagtcgagattgcaccattgcactccagcctgggcaacaagagcaaaactccatctcaaaaaaaaaggaaaagaaacaaaaagaaataaaaaacatctacatgtgaaagtatatacacctgaaaagttaactactgctaagaattataggtggatttctggatccaagaggtgccagacagccaactgtggatgcagcccttcctttcctcccctgttagcttccatagtcttcagccaggagatagggggcttctggggaatctaatctgactcaagggagaggataagacaaaaaatgcccttaaaccaattcagcagctattgaacccctgcaaagtgtggggtattttactctgcactgggaatacagagactatgccaagtactacttcaaggggttccccacctagtaggaaaaagacataattcttggaccccagagaatgaagtgtgtactatatccaccctaaagctcccagttacctttctctcctaagaaaagttccttttgatactggcgagagaaaagaaacccaaagtgtcctactcatgctgcttgcttctctccattaagcaccttcccatgcccctaggaaggacttggaacaaagccccctttcctaccatagaaggagcttattctctactcgggatactacatgtaaaacagtggaaaaataatcaaagaccacactgtgatacagtgtgccccaatatgcgcgagagcttgatccactctgaaaggatagtagcagtaggggctggggccaaggagaggctgctctatggctgggctcactccctaatcaagcgtaaaggccatccagctgaagcaggaagcagagaacaagcagtcctcagttcccaggcacaagacacacgtcttggacactgagacagggctccagccctgcaagtccacatggatctgaggagtgaagtcaccaggtccttgagctcaccagctccctataatgttcccactaactgaatgtcttgatgcccacagcattactcacctcctatcctgttctatccttcccctttcccccaaccactggtctgctcacgcccagacggtgaactcactctctaaaaagggctgctcacctcccttgggtgcaattagttaaccccaccccttcctccagcacttttgggttgggggccataactactatctccttctggacctctgaccaagtttagaggatgtccaattgaactgttagaagagtccaaagagccctggaaaaagcattagctcagtgctcagatcagctgtatccatgccatattgacatgggcacaggcctccctcccctttctctggttcagttttgtcacatgtagcaaggagaggcttctattagagatgcagtaatcaacctttgcccaatgttagaattccctgtgggagtgctcagaaaatattgattcccaaagccttaacccaaaccaattaatcagagtctacacgtgctcctacaaactggtcaagatcaattacacaggcaagctggacttccccaggtacaccctggccaaggtagatcagaaggcagggagcctagatggctccatgcaaaactcagccccctactataagaagggcagctctaacagtcaacattaagcttcattctggtttccaaaggtcatgagttcaaatttccccctttttccaaaccttgcttcaagtccacaagaaaaaaaattaaaatgtattggaactagcaaatccaaccccacatgctttgacatcaggcaagcattacaacttttcctttctctaaaggaccagtcctatctgccattgtgaattgtttttttcatttgccacatatggtctctatggcccaattttaagaatctcccacccttcacagagggaatggtgacaagagagagctgctcttcctgcatccacagccttttggctgctctagtgacacattcccatgtgatggtatcacattcctgagggcgtaccaactgcttgtgaccaggaactacctggccacagactgggataaaccatctacctcatgatgtcagcttatcacctgtttctggtgggttctctatgaactacctctccagggcacttcttccctcctcatccacatccggcctctaatgatgcctgttcacccctccacccagttatgctcccttacaaaattcagacacagctgaccacttccaactttttggagctggtagagttgtccatttggctcagttccgcacagaacaaaaccatttctgagatgtgtgccaccattcccgtacccatgggagggcagaccagcctccattgttaggggagtataacatttctgaataaatcagagtttcagagcaggaaatagccctcagaggttagccaaaccaacctcttgtggaacaggctatggcccaaaaacgagcaaggacttggtcaagattgctctggaaagctaacagcaaggcccagcataaacaacagctcttcaactaaaaaagagtgccttttccatgattctccaatacctcttcctctcaacaaaaagttggattgatgctcttgctcccaccaaggtacaaacaagactctacattagctaggtctaagcagcccccaaacaattctcacctactaataagcaactcccatatgtccaggagcatggcaaaacaaaataagttattggctcaaccaggtggaaagcacaattagccttgaaggcagtggtctgacactaccaagaatgggttacacaggaagccagttgcaaaaccagagtcaggccaggccccaagtaggcaggacacaaatataacaggtggccatccccacacagcccccaagtgctctctctctaaacattagtcttgacttacaatatttagaagagagactgaaaagaggttgggcaaccactggaacgggggaagggccaaatgtttaaagctgaaacttcctttctagcttcagaactctgacctaaccatgaccagagcttaagtccaggcctttatgaaacaacactgccttcccttcccacactccaccccgtgcatagtcgaaaaccaaagtcttctgtctcccaatcaagccttgtctccattactcattagctgagtaatttttgcagccacttaaagtctatgagccccagttttcccttatgtaaaagtaaagataataattcctggctgggtgtgttggctcacacctgtaatcccagcactttgagaggccgaagtgggcggatctcttgagcccaggagttcgcgactaggctggccaacacagtgaaaccctgtctctattttaaaaaataattttaaaaaagataataattcctaacctgccaactgtagagagttgatgaatatcaaatgacatagtaataacaataaaaaagagttttacaactatgaaacttgttacaaatatagagaattatcattacttggacactggaaaaaaattacagggcaatgccagccaacctgtcaagagattccttcaattcgcatctgacttggctattttaaacagaaaactatttggaaaatgggcagctatcccctaaaattataaatcctttccagcttcctaaccctagaatttctttttctgggatgttaagcagctagaggttccagaagaacttgccccaagaggttcctaatggctcttttaagattttctttaagcttggttcttcttgccaaaggacaatctcagtagagtgtgatgaagggagaactactcgactctccctggaataaaagtccatgcagggcacactcaaacatgtcttctcaacctccgatctttgaaggattgcctcctttctaatccgattctcataaatatgctgcctctacctgagttcacagctggagggatggtcagtgaaggcacaaatgacctgagaagtagaagcctatcactttccttgctccagagtgcaaagttcaccattttccttatagttaaggtcagttacccacatcaacataagagtaatactctatggattactcagcaacagcaacctaaccacttcaccctggaaacttttaggacacgtttgcataactaattatgtgttatttggattatcagaagagcctgtattccctgagctcacattatttagaacaggcagtccacaggtagctgagaagagaggggatttttttgtttgtttgtttgtgtgtttgtttgttttttgagagagtctcgctctgtcacccaggctggagtgcagtggctcaatctcagctcactgcaacctctgcctcccagattcaagcgattctcctgcctcagcctcctgagtagctgggattataagcactcgccaccacacccagctaatttttttagtatttttagtagagacggggtttcaccatgttggtcaggctggtctcaaactcctgacctcgtgatccacccgcctcagcctcccaaagtgctgggattataggcatgagccaccacgcctggccgagaagagagttttattatggatggttgagagatgattatatggcaatgcctcattggtcctaaatggtctataaatgagctgtatcacagaagtgaacattttctgataactgaggctcacccgtttaaggatcataactattcttagtggtgagctgaaagtctttcatctactgatatactctactgcttttgtcaacagagactattaaaacatgatttaaacttctctgagcacctgaatcctgaacacttgattttctacgagctaacatttcagagccttccactgctaacttatccaagtttcccaccaattctgaggttaacacataatcattcccactttaccaacgggagaagtggaggctcagggaggttaagggatttctccaaggtcaaacagcaagtaagtatggaaacacagatattcctgcaagcctggcctacaataaatgcctggagatactttggatccacaccttctcaagtagcccaaaaaattatttaaaatgtcatttccttttccttttggaacctgatctcaaactccctgcctcacaaagctcctgaaagtgccaatcactaagagtgtgcaggcagcttcctgtttgtctgaaggggaagggaataatgcctgcagtggcctgtgggcctagcccagtcagggtcaacctctggtagcagaggttccaggattaaaggctgggcaagcagaactctgccccaccaactgtggaagtctgggaataaaaaggcaagagaaaggtggggcctgccatgagtgggcagaatagagccagcatttctggtaattctgcttctcctctagtggcctggttccttcaacataatcaatactctcaagttagaaagcttctaagaccaggaccagtgaccactaggctagaatttttctttcaaaatatttgtatttcacaaatcactatcttcctcaattattcaactggtggctcacctacagctgagtgctctgcaaaattccactttcctaccacctggacaagattcctgatgtgtatgttgttaggaaggggattctaatctagcttctctgataattgacaggcccttccacagctcttctttgtttgtttgtttgtttgtttttaagccagtcaaatttagcagtggggggttgtacacccacttcagtggctgaggcgtggtggctcacgcctgcaatcccaacactttgggaggtcaaggcaggaagattgcttgaagccaacagttcaagaccagcctggccaacacggcaaaaacctgtctctactaaaaatattaaaattggccaggcacagtggtgcacgcctatacttgggaggctgaggcatgagaactgcttgaacctggaaggtggaggctaccgtgagccaagatcataccactgcactccaacctgggtgacagagcaagactctgtctcaaaaaaacaaaaacaaaaacaaaaacttcagtgatgctaatgttaacaagttctgacaacccagtaccatcggtaacccactaccatcggaccagcctccactgctcttctgtggagaacattggaaaagcatgtgcctatcacaaacacacacatatgtacactcacaaagtttctttccttcacctcagacagctccaacagccagaggtcttctgaggtgcaggattctcagtcaggtactgtctggaatcaaaccaccccaagctggcaaaaccacaaaacaggaaggggaccatgctaagcatagaaaataagtttatcctaccactaatcactccactgagctcatttagacacaggatctaaagcaatctctataggtggggcctactgagcatagaaaggggagcagctaccatcatctttcatcgcaacagaagggttcacatatcacatcttcagaaaaccttccctctcagacagacaaatcctcattacaacttctttattttccacttaatgaagagtatggcccctttatttgtgtagattttaagtgttccaccaattcatccaggcattggtggctcacgcctttaatcccaacactttgggaggctgaggtgataggattgcttgagcccaggagctcaagactagcctgggcaacatagctagtaccctgtccatacaaaaaatagaaaaataactgggcatggtagaatgcacctgtagtcttagccactcagggggctgagacaggaggactgcttaagcccaagagttggaggttacagtgtgctatgatcacaccactgcactccggcctgggtaacagagtgagacgctgtctctatataaaaaagcttttttggccaggcacagtggcttacgcttataatcccagcactttgggaggccgaggcgggtggattactggaggtcaggagttcgagaccagcctgaccaacatgatgaaaccccatctctactaaaaatacaaaattagtctggcgtggtggcatgtgcctgtaatcccagttactcgggaggccgaggcaggagaatagcttgaacccgggaggcagaggttgcagtgagccgagatcgcgccattgcactccagcctgggcaaaaagagcaaaactctgcctcaaaaaaaaaaaagaaaaaaaagattttaatgtttaaaaagtgttctacctatttgctgatttgcttattaatgagcccctgtagactttaaaatcggatttgacattaaaagatggccagcacatactaagttaaaaaagcagaacaatacggatttgtactatctgtgcatttaaaggcatatatatacaaatgcatgaaaaaagagtctatgggctgggcgcagtggctcatgcctgtaatccccgcactttgggaggccgaggcaggtggatcacctgaggtcaggagttcaagaccaggctggccaacatggcaagaccacatttctactaaaaatagaaaaaattagctggacatggtggcaggcacctataaccccagctactcgggagactgaggcatgagaatcacttgaacctgggaggcggaggttgcagtgagccaagatcgcatcactgcactccagcctgggcaacagagcaagactccatctcaaaaaaaaaaaaaaaagaaaaagaaagaaagaaaaaaaagagtttatgttcacataactaactggttaatgatggttgtctctggagaatacagtcaggggcagaagacaggaggctttatatttttcaatgctgtttcatttcttacaacaaacatgtttagtttcataatgaaaaattaatccaaaattgtaaaacaaagtctgtatttatttaaatctgttccaccacacagcagagattgtgtctgttaactttccttatatggctcaggactaaaaaaacagatgggaaaagtcctttaaagactaggtgaacttcagaagctctctctattttaggacagtcaaccttacctagtaagcataaacctacacctctcaaatgctggccctacccttttctcaggagtggatgggaggaaaatatctcctactgcccccaaaattagtctaccttggccaaaaaataccaagtctgcaaagataagcagctctgggccctaaagcagcctgggtggtggtggtggtggtggtggtggtggtggtggtggtggtggtggtggcggcggcggcaacagtagcaatagcaagagtggatatccactggatgccccaacattatgatcgccaggacttccttgctatcctccctggtctatgcctgtctcttcctaggcctcagcacaggggccaaccaaatccctaaacctcaggtgcacaaacctctcaggattaaattatgcaatgcagccctgcctgctggccatgccataatgagcagcacaaacacaaaaaaattaaaaattgagtaatgtctcaaatatgtactgtacagccaaactttgggctacttcacaaaggtggacagaaatgtttgcatggctgcctgttagaatccacaaaaagttttgatttgaatattcccacttgacacgaacactactgtattatgtgaagatatgggaaaagggagcagaaatggctatgaacatgctggccactcacagataaacagtctctccaaggtgcacaagagagacaatgccttcccattccccggtgctaccctgttccattctgccagggcccagctgggtccacattaggtagtttccagtggatcaatggaattgttgtttggctatctggtagatctagctaaaggaatctaaagaagacagttccaacatgaaaatagtagctattaacatatctattcaataaatatttgttgagaatctactttatgccaggcatcattgtgttgggtaccggggatataatgggtggtgagaaaccatctctgttctcatgaagcttacacactagtgggctagactgacataatggaaagaacacactcctgagagtcttgccttcaataccagtttctgcttctgcctcaatacatgaccttgagcaagtcccttcttcgtgttgatttataggtgaccagtagatcttccactggctcaggtaatttgcttccttacaaaacataaagtcctggggtggaatgggggtatgcaaatggccaaggcagcagcaagaagccaagggtcccaacaacaacaataaaaacaacaaaagaagccatgggtagtatgtggtgaaaacaaaaagcaattaattgagattctccactcaaagaccttgaatttggcttagatggttcttcatgaactgttttcctaagacagatgagatgggcaggcctctaaagagtatacagttagtgacagacatgaagatctgtccttcccacagtacatggcaggcttcagaccagaagacctgaaaggtgctcagtttcactgcagcttctacacttctacctatagctaaagggatgttaagaaaccctctactctaaaccacttattttatactaaagagctaaggtgatggtggcccctccctccccaggcacttgtggtcattcttgagtagggctgtgctagggccagttggagtcaggctgctcaaatgagtgaggagatggtacttccctgcatacttcctacttaaaaaaaaaataaaaaactggctgtaggggcacctatgtggggttcagagaaactgtagcatctggcattctgggttcagaggcttgattggaatcacatatagcacagaactttaaaaggccaactggaacaaacatactggagtgtcctgggcctaccttccttcctttgtgcctcacacctcacagaccacttgcagatgcattagtgcactgaatgaatcctcagcataaccctaaaaagtaggttgctattactctttccattccacagatggggaactaaaatctggaatggtttcagaatttgcactggtgactcaaggccagctaggctttctctgtacttacactcaggcctctcttccccataggtgctaatacacctgtcccttctccaaggtgtattttctctattactagtggttagtatgccctaccaggtgctcatccaacactgttggatcccctgcattcattgctactgcttctccctcaccatgtatattactgaccaaatgctcctcaaaggtttgtccattcctaaccacctccacctggagaatggccccttcttgagacaggaagagctagaagcttccaaatgcacacgtttaatgaaagagcaagcctaggagcccagatggctgcaattctgcatggtaaataacataacagaagttcttacaaagtacagtgggcacatagaagatagtacaatactatctgggagtaataaagaaagtttccaatggaagtgacatggagtgggggggagatgaagaagaggcacctgaaatttcaagctgaaggaaagaacataggctaaagcagaaagaagaggtatggcattgctttccacagttaaaaaaaaaatcatggccaggtgcagtggctcatacctgtaatcccagcactttgggaggctgaggtgggtggatcactttaggccaggagttcaagaccagcctggccaacatggtaaaaccctgtctctactaaaaaaatacaaaaattagccaggtttggtggcacatccctgtaatcccagctgctagggaggctgaggcacaagaatcgcttgaacccaggaggtggaggttgcagtgagccaagattggaccactgcactccagcctgggcaacagagtgagactctgtctcaaaaaaacaaaacaaaacaaaacaaattcaacctgaaaaagctggatgaaaaaaagaaaaaggacgggtatagcttacttggacttgggaaaccttgggcccacaaagctaccacatagcatacatgtgggaataaatgggagctgagttgggagaggaagctagaatggggtgaggtaccaaagggacctccctatatgctatgctaagaggtttcaattttctcttttcacattcatgggaatgtatctatactagcaaatgctgggagtaatctaaatgctcccccaaaggagaatggttttaaattatggcatagcctttgaatagaattttacatggccattagaatgttcatttcttaaaattaaatagcatttatctaagtttttagtgatgtgttaagtagggggaaagaaggagaacttttttatgtacactatgattgcaccaccaaaaactaaggtacatatatgagatacgacaagaaatacaaataattattgccatgttaaaatgatgaatttatacacaatttctctctctatttgctaaactttgtcatatgccatgctgagttttaaaaaaaggggaaatataaaaaaagaaccactcttcttccatttgactctacattccttcttcctccacctgcttgcctaccttcccaaaccaacagccattttgatccaccacctacaactggcatcgctaacaacccatgtgaggtacctaggaagaatgagaagcttccagcaaggcagctgcttccagcagcaagctcctgcatagcccacaggccattccagctcaatgctggagaagaatcttccccctaacagcactgcccagcactacccaactaaggcttctctggttaaactgcccaaggatgcccaaggaacttgtttctaaaggaaggaaaacagatgccaagacttcttgtgctttctccagggggctcagagcaggtaaggtttatgttcatggccaactcttaggtggctgagatccaatgtgggatccttgtttcacaagcaagcactggataaagtgtcagtgagaaggacgaaaaggaggaagaagtagaggatgggtaaaaacagatccagtgaagggtacacctttcccataaacttgcttattccctatcagccttgtaggccctcacagaaaattcagaagtccctctcctttgatctccaggactaataccaaaggaaaccatatttacaaaatacaggatcagttgaaagcccaacactaggtgtgtggcaatcttcctgactagaaattctcccttttgctccacccaagcccatatcacctagctctccccgtccaagggcaacatagtcaacaatgattcagatagaggaaggggaaagggagcttagcaatttaagactcagtcaaaagcaatttcatagccctacaaaaagggatgttgtgggggagggagtaaaggaagtgaaatctcatatgtcctcagttttagcttgtttctttgtcttccctttccctgatggaacaatgaccaatccaagggtcttctattcttcctgagtcacagatgaccaaaaatagccagcaactgtagtctgcaggctggactccaagaccccacccaaggcatgtagtcaacagttgtctctccaagccagaatctccacagtgagctctctggtaggtagattcagtatatcccagagcagagctcactgaaatagagggggctgcttacatgttgatagccagaggagaaaatgacacactcaatgccattctaaatgggaaaaggaagcttctccgaaaagtcaccactctgctctgctacacgctttccaagacccctttcctagcctcttaaagactgggcacaaataatcagaatgtcagaaaaagccaatgtctctattttgtagataagaaaattaagcctcataaaagtgacttgcccaaggtcacacaggcagagattaaaaaccaaatatctcactcttctttccattgtaccattttttactaaaaggtatttttaaagacacccagacaagtgccccaagctgtaagtgtcaaaagctcagctcttctaacctaaagttagacagctcaggactgggaaggggaggtagagggaacttagactcagcccacccaggaaagccaagtgagaaggctaggcatacaacaggcatacttaaagaactagacttaccaactggaaggctttacctgctccaaagaaatagtttcaaatgctgaaagccctagccccatcccacccccacactctgaacctctttaggccaatcgagaccactcctaggctgtcagagatctaggtaagaagctgtagaggagtgaccaggcagtgccaagaggataaagggagataagaaagcagggtggagaaatcacagtcattccagagctctcccatcttcctctctccttccccactcctcccctatattaggactctaaacaagaagaaaagaagtttgcaggtggtattgtataaacttgaagaaggcattccctgtactaaaggagaacagaggactagttgaggtggggtggcaaggagagggagtaacttgaggggggagaaaatagccaaataaggcagacttgactggtaggaatcatcaggaaaggttccagaagttgacgttgcagggaggaagcctttagtcatcggtttcctctggcaactggcctaagaccagaaggaaaaaaactcccaaccttaggaaaatgcccaggctatggcagacagaaaggcaactaggctagattttcaccaggcccacatcaggccctgctggagcaactcttcaagcactcaaagtagaaagatgtagtgtaaccctaaagcaaatggcagatgtccccaccaagcatatgctagatctacaatggcccaggcaccaaggggaataaggaacctgggaggggggtttgttcttttccatttacatatttctttttttttttctttttttttagacagagtcttgctttgtcacccaggctggagtgcaatggcgtgatctcagctcactgtaacctccacctcccaggttcaagtgattctcctgcctcagcctcccaagtagctgggattacaggctcccgccaacacgcccggctattttttctatttttagtagagacaaggtttcaccatattggccaggctggtctcaaattcctgacctcaaatgatccacctgcctcagcctctcaaagtgctgggattacaggcatgagccaccacacgcaaactccatgtgcctctttctaatattgctgatattttcatgttggagaaaaagaaaattaaaaggcaaagaagttatgtgacttttcttctttgtaaaggaattagtcagtctcccacaagtatctacaaggatgtttggagaggagtttagctcacttaaaacccttgaaaatagcaaagatttgtacgacttaactaatgatgcccagattgactgttaccttgaccctcaccctccaactctataccatagattagtcaacctcagttaaaaattacaacagataaaagaggctcttggtgagcttcatcaaacatccaggctgagaatctgaaaaaataaatggatcagccaggcgcagtgcctcacgcttgtaatcccagcactttgggaggctgaagcaggcagatcacccgaggtcaggagttcaagaccagcctggccaacatggtgaaacctcatctctactaaaaaaaatataaaaattagccgggcgtggcggcgcacacctgtagtcccagctacttgggtggctgaggcaggagaatctcttgaacccaggagatggaggttgcagtgagccaaagtcatgccactgcactccagcctgggcaacagagcaagactccgtctcaaaaaaaaaagaaaagaaaaaaaaggaaatggatcatgggttggagggaaggcagattagatcacgaaagtaagatcaggaaccttatctaaacacacaacttgagaaaaataagacttgatccttctcaggtatttaatggaggccaaggctaaagagagggaaagaaatactgatcaagcctgacaggtatgccttgttccccctcctaggccttggccccagtcacttcccaaatatatacccaggaaaaaaattttcaggattatatcttgttttgtacaaccaaattgtcatatctcaactcttctctcattaggccctgatcactaccctggatgcacaaagtatctatcaaattcccacaaggtagaagggttgccaggaatgggaagaaacttcaatattcgaagtcaccaatcacagaagataactggcaaaacagttctactaagcaagcacagagccatttgccatattagtggcctaagagctatgtcaacacttaccttatgccacaacaagccgattgaaaggagcatcagatctggtatctgtgtcattaggcacagacaaagggctgtgctttgaaagtcgcccaaaaggccttttctccaaattcaagacccagatgctgcagctgtgccctggccagaaaacgtcatactcctccacctctaacaaccacacactgagaaatcctccctgccatctccaccctttcccaaatacctgattttatagcaaagtcaatgagagaattaaaagctgtttctaggctgctgacataaagttattgccaagctctattctttggtttagttcatgtgtaagcatgaagaaaagaccctctcacatacctacttaggcaacaaaagcaacatttttaaaaattaatttgcccaggctgggcgtggtggctcacacctgtaatcccaccactttgggaggctgaggcgggtggatcacctgaggtcagaagttcaagaccagcctggccaacatggtgaaaccccatctctactaaaaatacaaaaattggctgggcgtggtggcgcatgcctgtaatcccagctatttgggaggctgaggaacgagaatcgcttgaacccaggaggcggaggttgcagtgagccaagattgcaccattgcactccagcctgggcaacagagctagactccatctcaaaaaaaaaaaaattaatttgcccaattctggaaaaccaaaggtatggtctcccccacaggcccttgtttgccaattaagaaaggattgttggatccaaattaccctagaaagagtagcttcatctatgcttatatctgtggctccccttgaatcagtcagcagctcaagcctcccttcacttcagataaagtaactttcaagagagcattggtctagggccattggtttacacccacataccaaaaacacatcactttcccacccagaacggccactgctcccaagtgtacacaccctttaaggccctgttcatgtcccagtaaaccctttctcctcaaaaagttgtagaaaatgcaatgcaaagtatatatttttctcaagccgtttttaagtgaattagccctaaatccccaattaaataggagataggagatctttgaaggcagcagttgtatcatcccttcatttatttctatcccttatggtaaatagtacatagtaaccactcattaaatggtaagaattcaactacctgtcttctttcttatccatcccatctagcacaaagttaggcatatagtaaaattcagtaaataatcataacatttgtatatcacttgttagattctaggcacagttctaagccctttacataaattacctcatgtaatcctcacagcaactctgtaagtactattattatttatggttaaggaaaatgaggtgcagaagttaaataacttgtccaaggctatataactagttggtcgcagagctagatttgagtccaggcagtctagttccagagtctgtttttcaacactactctatgcttcctttccacggaggcttgaaaggtctttttttagcttcctgccccaggcttggcctataagcacctagaggtgagtggtgaactttgaggccaggagattctagtctgcattcaaacaatttgctacagcagcaaatactgtcactaaattgaaaaagtgccatactgttctcctaactcaagggacagatcaagctggagcgctgagtcagaattcagaattcaaaaaggtcagagctcaaaattaaacagggcaaagagaaagcagggaactggggtgaggggtagacaggaagagaagacagtcatcggagatcccagaaaaacttgctatagcaaaaccattttaggggaactccattgtacccatcttgttaatgtaatcaccacagagccagttctctggaagtctgtgctctctgggtggagtcatccttctaagacagccaagtccagtgggagaccactaacttgggaattaggaaatccaagttctcctttcaatactgttaccaactatatgtgacctcgaacaagctgcctaacccctctggctatgaatacgatgaagaaattactctctaaagtttcttaggacagcaaggcctagtctcaagcaggaaaatgtgactagtgtcctctctctacctcccttcagcctacacatatgccttccaccacccgtcacaagccaaagcaaaacacttaccttcctgggaagtgctacaaagagttcctgagacaaggtcagagcctgagccatttccaaataaagaaacccatgagatcagctctacacactcagaggaacttgctcttcccatggccataactccacggtcatgtcaccaccagcacagagggagaagacactgagcacctcacagtgagtgccatttagaaggtaggcattcaccatccctcccctacactggagccaagcaagttaggttttagtcctggcactatcaccagttcactcaaatcctttcccttttctggactttagtgcccccatcaagaagataaaggctgaggcagaagatttaaggccagctcagttgttccatggttcaaaacactcctgtgagaaaccctgcccatccagaacaaccagctaaaggaaagcttaaggctagggaagctctgggttgccctagatgcaaatgcctttaaaatgctgtaccccatacaaaattagctgggcatggtggcgcatgcctgtaatcccagctactcgggagcctgaggcaggagaatcgcttgaacccgggaggtggaggttgcagtgagctgagatcgtgccattgcactccagcctgaacaacagcaaaactccgtatcaaaaaaaaaaaaaaagctgtaccccacaatagccagtcctcagctcactggtggtagatactttatgaggtttgtttaggagcccttaggaaggcctcaatatctaccaatatatctaactaccacactcaccatgttagaagaaaatctgaaacataatctagtagcttccgggccttcctttcagcagaaataaaaaggactattctactatcaggcaggcggtcactgaaaaatgtgggaagaatggcaggaaaatctatgaggcttttagtgtttgtccaaagcttttcagtcaacccacagtcttcataatatactctcacttggtttatttctttccacagtaaggaaagacacagccctttctctcccatgactcgggaagaaatggccaagagtactcaagccagtattcttcttggatctactaatgaaacaaaccaactcccatgtgagaaacagtccattctgaactcagcacttaagaagaaacagcactcaagaagtataatgggacaagaggatacattttaataagcgctgttcaattttgtatttccaatactgcctggcacatagaaggtacccaaatgttgaagaaagaatgtctgaaggaatgaacatacatataagagactcaatgctcttataccatcaagattctcaaaaacatcagtactggagggattcctagagtttacccatcactggtacagctccctcatgacaagctggagagacagagggcctgaagaaaggacttgcctaaagtcccacttcatttggctcactttactgaggacaggagagaagttcttcttatatggaaagagaagaaaaattctcagttcagtgatgctttccatttcccagcacccaccttccaaattcatggaatcctgagctaatcctccaaagtgacaacttctataccacagattagaacctggaattgaaaagtttttcagctctctcaagcatgaaatggaaggagggatggacagcaaagccagtcagtcatgaaaagaccacccccttcacttgaaccaacagactatcccaaaggagaccacatctgtaccctgttttttcctttttgcaagcaaagtaatagagcaggtggcagggaaagaagattctgagttaggaaagaggcacatgataaattcaattctatctttgaaagattagagacagactattagcaatctgtaacaatgccaaatttccagcagctatggttatgaaaggcctaactctggtagtgttggtagccagatattctcccctctggggaccctgagtctagaaattccagtgggggaaactcccagaaagatacaaagggacctaagacaggctgttgccatgcaacactagaacagagttcagaataattgtagctgtcatattatctcatccagagagaattagatttggaggcaggggaaatagactagatgacttccaaatgtcctttccagctccatcattcggtaaagtagtttcatgggaggaggaggtaagagaaaagtaagaacaacaccctaaaacaagctactgttgcaggcagctagagaatggaaagttagaagattagtgatcaatactacttctatcactgactcacagagcaacctttccctctccaagcctaacacgagagagcatagattagttggtgtgggtcccacaaaggccttcctgccccaccagccccctccctacccagagggctgttaaaagaaaagcgtaaaggaaattcccaagatggttcctgctctgtctctatcatctacactttcacaaagggccaagtgaactgaagaacccaagtggagagatgcaggatcctctctcatatgacctctcttcctgatccttttccccccacttaagtctgtaggcagggctggttcaagggttaaaagactaagaatctggctcctatttaccaagtaccactttagtgccactcgagtggctcaagtaatgctaggaatggcaggagaataaacagtccacatagtccctgttaaagtttagctgaatgccgacccaaacaccttcaaatacttcaaggatctaggctctatgtctgctcacattgatggtcccatcaaatgaccactcgattgcctttcccctgatctgttgatctatggctaaaaccccagcagatcaaagaggtgtttcaccaagactgaccctctaactaagacctagattcaagtcctagttttgcaactggcatactgcatcactctaggttagtctccccctaacatgagtttcagtttcatcatctatacaatgagaggaattggactttatagttgtggagagccttttcaatactaacatctaataaatcccaaggaaggaaaccagaaactcaagaacatctcgaaaattcaaaacactctttttttaggaaatccaagaaagcctcaaagcctttgtgatcctaaaagaaaaaaattaaagaaggtagggagggggaaaggcctttttaaatatatatatatatatatatatatatatatatatatatatatatatatatataactgtcatcatcaccaaaaaatgtagatggcaattaataagcttttccattctggctactaaagcagactcaggaaactggcaaccagaagcagagtccaaggaatggcaagaaggcaagggtggcggtgggtagtgaggcatgtttttttgtttttttgctttttttgtttttgagatggagtctcactctgtcacccaggctggagtgcagtggcgtgatctcggctcactgcaacctccgcctcccaggttcaagcgattctcctgcctcagcttcccgagtagctgggattacaggcgcacaccaccacgcccagctaatttttgtaattttagtagagacagggtttcaccatgttggtcaggctggtctcgaactcctgacttcatgatctgcctgcctcggcctcccaaagtgctgggattactggctggagccaccacgcccggctggcgtgttttaacaaatgtaggggaggttgggctgactaggagggacaattagctataaaagtgaaaccgaccctagataggttgtagacatgctgcaatatgaatgaacgagtttgattttccactacctttctccatctgtcacacgctagaaatagcctaaagcacataaatgaaaatggagcagagaaagggaaattttttccccttttaattaaaattactggttggtattcagtgaactagggtgtgcccctgaacaccttggccttggtatgaggaataagaaaagtaacagaaggcacctggtgacactaccgaaccttaccaggagaccacacaaatgtcaaccttggccactttgctcaaattactcatttccttttatctgaggaccataaaggtctgagaacagtgggcaatttgtttggagcaagaaagggaactcaaatgtcaagaactcaatcattgggtcagaataaagggtcaatgagatgagcatcagaaagcctggaccccaatcttggctcagtcaccatgtgcccttaggtaggtctttccctgtaggtctcaatagcctcattagatttttgttttagttttagtttttttttttaagagagttgtactaaatagtctccaaggtccctttcaggttaagattctatgatcttaacagacataatatagttgcttttcctaaaagttgaccattccttgagtcaaagtatagaaaattctctaatacttccagtctatcaaaattcagccctctccttccaatttgattcaggtttcagtcaatctgcataaaaatgccttcagtatttaggtaccctcattactccaggcctgactacaaacagcttatactccattctctctccattcccaggaaaacaataaacacgctgtcttgtcttctttgccactttgactcagatgagacggttaatgcaagtttgaagcaacttccaggcccatgaagctgtgtttcaaagtgggctatctcagaactgaggatgagatatgccactacagaagaaagaccgtggagcaatgtctattcccagagatccacccaactgttcaggcaaagccgcaccttaagaggagtcaggagtcaaccacagagagagacccaaagagccgctcctgacaggatctttataatcttgttttggcagacaatgggatattttcccctctctccaaaaccattactctctctctttgggggcggggactagggaacaaagtgtgtaaaagcctcatgtcctaaaaccacaagcaatttaaaggagatagacagtgaaagcacatactttttgaaaacttggtgtttctgaaggacaaggttctggaaaggcaagaacgacttggcagtgaggctggtatacagtaacgtggcaaccaaagctcatcacaaacccaaaaggctgggcccccaactctcctcctctcatcccaggggaccttcagcccttttcaaggctactagtcactatctcacctctacaaggctcaagcagtcctggggagacatgtttgggagcactgcattgcctaggccagctcaacaagctgtttggcctaagggactcaagccagggtggtcaccaggcctttctgagcaagggaagggcctcagcagccatttggcatgacttgcacaaaagcaagcagagctcattagtcaggcacacccctcctcccctctccctcctgggcatccggcccccctatccccactcccaggaggcttctgttcctctcgtaacagccagtggggtggagacgcatccccaaatcaaccaccactctagaaaggtgtggccccacgagaaaacccacaccacacaaaatagtccggaggggataggaggagatagagaggcattaagcaataggaggggcagggatttggaggtggagaggagggagaaaccggtcctctctcccaggagatggggtaggcctctcctcagactggtgcctaaataagtgttggtgctctcgggtgcagcctcgatgacgatttcctcacatctctctcctcacctcctagtggaaaacagctggagccacccggtgaggctgtgggaaagatgagtgggggtgccggatccgccccgagcggctccctcctttctccctgcttctctgttcccatgtcccctcttggacattggcagccttgccccagaaaggtgccaattcctgggttggggaaagtgttgtcttctggaccagaatcctctcctctgtgcccatggcccatcagggaaaaggggaaaccccaggccccaacgaagccgtcctgactgttgcatctcagacacagggaactggaacctgagaaagaggcaggcctcgccccgtccaaacttccagcctggacaccccctcaacccctgagggcgcaccagaccaggatcccactccggtcccctccctacccttggctatggcggagggcgcggcgtcccaggcgggccggtggctggccaagccctcagccatcagcaaagggctatgaggctcagccagagccattggggtcgacagcgcccacctccggcactcaccgttttgggcatggtggcggcaaaggcagcggagttggcgaagtttagctaggactgtcgggcagtgctgagcacgcagtacacacggcttggattcggctggccggggactcagattgggtccctcactagcgtcggggcgactgttaggcttcctgctaacgggccacgacttcacaaaccccacccaggaaagagccgcccctgtcgcgccgcccgctcctttatgtggcccggcttccgcgccgctccccgccctcgcgcccgcctccccgccgaccgctggccttgccccgcccagccccgcctggccaggcccggcgcagccaggccacagcggccacgtggggggcccggctgggcccgggcggacctagggtagctaccactccccacccagacccacccggctcctctcccaccctggtcacagcccctagccttccacgtcctggccttccagccccacccccactcagggcccagaccctgggccctgacagatgcttactcagcccctgactgcaactttccactgatggggagctcactacctatcttttccttctctagacagctctggctcttagaaagttcttgccgtgtctgaactccttttctctatggcttccatccatggatctcagttctgctccctgaggccacacagatcccctgttgtccctaacagctcctcaaaggcctgaagatctcaggtccacaggaaacttctcttcttttggctaaactgcctcacctcttaaaacacttcatccattctcttccgtaggactctccccatcatatttcctacccatccttgctcagtcctcatttatctttccttcatctaaatcccagtcttcaccttcctcaaatcagtgacctgatcctttagcccctctcccagtacattcactttctgatgtcctgatggggctggctataattccctcaggttagatgtgacctccctagtccacacccttggggtttgtctgccagctccctttctccttcttgtcaaggtcacagaatcccaggatggcagtgttctagactgttgaagtcgtctggtcaagtctgagttttaggctgagtgcggtggctcatgactgtaatcttaacactttgagaggctgatgcaggaggattgcttgagcccaggaattcgagaccagcctggggagcatatcaagaccccctcccatatctatacaaaaaaaataagtgagagccgggcatagtggctcactcctgtaatcccagcactttgggaggctgaggcgggctgatcacctgaggtcaggagttcaagaccagcctggccaacatggtgaaaccccgtctctactaaaattacaaaaattagccgggcacgtgcctgtaatccgagctactcgggaggctgaggagggagaatcgcttgaacccgggaggcggaggttacagtgagtcaagactgagccagtgcactccagccagggcaacagagtgaaactctgtctcaaaaataataataataatagtaagtgagaccatgtgcagtggcttacacctgtaatcctaccactttgggaggccaagacctgcagatcacttgaggtcaagagtttgagaccagcctgctcaacatggcgaaacctcatctctattaaaaatgcgaaaaaaaaaaacaaaaaaattagccgggtgtgatggcacgtagttccaggcactcgggaggatgaggcaggagaatcgcttccgggaggcggaggctgcactgagcccagattgggccactgcactccagcctgggcaatagcacaagactccgtctccaaaaaaagtaaaataaaataagtccgagttttagtttgaaagtggctggccatagtccttttttcctcctctccactggcaaccatgtgaaggcatggtctgagtatcctttgtgaggtaaggcaccacagatggtaagccagtttgagacaatggaaaggatacttgagaggtcaggacacctggcttctacgtatagctctgccattaactcatcctatgaccactatgtggccttgggtaattccctccccctctctgggcttgagtttccatttctgtagcaagaaaggactggactccggggcttccaaggtcctttcccactctgacattataaagggatgagaaaggaagtatactccctaggacaatagatgagcctaacaggattgcatatgggctggtcttgcatttgcactcaggaaccagtagtctgattccatcctcttcctttgccttcccagaccaacagtgtccacgattcagtgtgcctcggtttctctcactgctaacaagattcattgatgtgtgctagggtaaacaaagttccctgccaagatcatttccttgagctaagcatttgttcaaagagcagcactcatcggaaagcccaaacagtctccatgagcagttgtccccaaggaagagcagcactcaccagaaagcctcagcagcaggagtagcaatgacagctcatcacacgccttaatactgccattggcccttttccaccagatgttcaaggaactcaactgatttcttcactcatgttcacctagaacctacagggacctggcatgaagctaaatgcctaaagacaaagaatttacttggcgactccaactttctggaaagtggaaactcccttgtgtcattccccacctcccatgccaaccactccccacaacacacatacacaggggagagttgggtagagagtgtcaagtagctgaagacactactaaaagggaaacaaggaccaggtgtggtggctcacacctgtaatcccagcactttgggaggctgaggcaggcagatcactcgaggtcaggagttcaagaccagcctggccaacatgggaaaaccccatctctactaaaaatacaaaaattagctgggtgtggtggcatgtgcctgtaatcccagctactcgagaggctgaggcaggagaattacttgaacccagaaggcagaggctgcagtgagcaaagatcataccactgcactccagccagggtgacagagcaaaacactgtcttaaaaaaaaaaaaaaagaaagggggcatagaagtccaagcaggggcagggggtgtcagaggctcggggagctaagaaatagggggaaaggggctgagggagaaagatgaggttggacctctggggaggagaggatgggaaatagagagagagcataaactatcagagactagttagtccagtctcactccaggtcaggagaactggggatcagaaagaggaaaagacttacccaaggccagatagctaatgtacagaagacaaagagctcagttaagaagctctggcaatagtacaagcaagaaattttttaaatattattttctcatgttttattttagatacagggggtacatgtgcatgtttgttacatagatatattgcactcaggtagtgagcatagtactcattaggaagcttttcaacccatgtcctcttccctcccacctctagtagttttcagtgtctgttgtgcccatgtttatgtctgtaggtgctcaatgttaagctcccacttataagtgagaacatgcggtatttggctttctgttccttcactaattcacttaggattatggcctcctgttccatccatgttgctactaaggacataattttattcttttctatggctgcatagtattccacggtgtatatgtaccacattttctttatccagtcgactatttctttcttttttttttttttttgagatggagtctcactctgtcacccaggctggagtgcagtggcgtgatctcggctcacttcaagctccgcctcccgggttcatgccattctcttgcctcagcctcccaagtagctgggactataggcacccgccaccatgcccggctaattttttttgtatttttagtagagacggggtttcaccatgctagccaggatggtctcgatctcctgaccttgtgatcagcccacctcggcctcccaaagtgctgggattataggcatgagtcaccgctcctggccttagttgaccatttctttatccagtcaaccattttctttatccagtcaaccattgatcatgggcacctacattgatttcatgtcttcgttactgtgaataatgctgctatgaacatgcaagtccatgtgtctttttggtataatgatctattttcctttaggtatatacctagtaataagaatgctggaacaaatgtagctctgttttaagttctttgacaaatcttcaaactgctttgcccagttgctgaagtaattcacattcccactaacagtgtataagcattcccttttctccacagcctcgccagcatttgttgttttttttgacattttaatactagtcattctgactgatgtaaggttaccaccttacatctgttagattgtgggttagatttgcatttctccgatggtgagtgatgataggcatttttttttcatatatttgttggccacttgtatgtctttttctgagaagtgtctgttcacgtcctttgctcattttttttttttttgagacaaagtttcactcttgttgcccagactggagtgcaatggcgtgatcgtggctcactgcaacctccacctcctgggttcaagtgattttcctgcctcagcctcccgagtagctggaattacaggtgcatgccaccacgccttgctaatttttgtatttttagtagagacagggtttcagcatgttgttcaggctggtctcgaactcctggcctcaggtgatccacctgcctcagcctcccaaagtgctgggattacaggcgtgagccgccacgcctggccctttgctcattttttaatagggttatttatttttagattattgatttgtttaagtgccctatagattctagatgttaagcccttgtcagttgaatagtttacaaatgtcttcctcattctgtaggttgtctgtttactctgttgatagtttcttttgctgtgcagaaactctttagtttaattaggtctcacttgccaatttttgcttttgttgtaattctttttgagacgtagacaaaaatttttcaccaaggcctatgtcaagaagtgtgtttcctaggttttattctgtgatttttatagtttgagatcttaaatttaaatacttaatccatattgagttaatttctgtaaatggtgaaaggtaagggtctagtttcattcttctgcatatggctagccaagtatctcagcaccttttattacatagggagttctttcctattgtttgtttttgtcgacctcgtcaaagatcagatggttataagtatgaggcctgatttctgagttttctatatattctgttccattggtctatgtgtctgtttttgtaccagtaccatgctgttttggtcttgatagctttatagtatagtttgatgttgtgtagtgtgatgcctcaagctttgttctttttgcttaagattgttttggctatttgggctcctttttggttccatgtgaattttagaacagttttttctaattctgtaaagaatgacattggtagtttgatgggaataacgttgaatctgtaaattgctttgggcagtatggctattttaatgatattgcttcttccaatccatgagcatgggatattttttcatttatttgtgtcatctccaatttctttgagcagtgttttgtacttctccttggagagatctttcacctccttggttagctgctgtactcctagatatttcattttctttgtggctattgtttggttttgttttgagatggagtgttgctctatcacacaggctgtaatgcaatggcacaatctcagctcattgcaacctccgcctactgagttcaagcaattcttctgccttgacctctgagtatctgggactacaggcatacgccaccatgcctggctaatttttgtatttttagtagagacagggccatgttggccaggcaggtctggaactcctgacctcaggtgatctgcctacctcaactttccaaagtgctgggattacaggtgtcagccacagtgcccagtctctttgtggctatggtaaatggggatgtgttcttgagaaaaactggtaccagttctactgaaactattctaaaaagaaattgaggaggtggggctcctcgctaactaattctgtgaagccagcatcagcctaataccaaaatctggcagagacaaaatgaaaaaagaaaacttcaggccaatatccctaatgagcatagatgcaaaagtccttaacaaaatactagcaaacaaatccagcagcacgtcaaaaagttaacatgccatgatcaatcagcttcattcctggagtgcgaggctggttcaatgtatacaaatcaataaatgtgatttgccacatacacacaattaaaaacaaaaatcgtatgatcatttcaatagatacagaaaaagttttcaatacaattcaacaacctttatgataaaaaccctcaacaaactaggcatcaaaagaacataccacaaaataacaagagccatctataggtggctcatgcctgtaatcccagcagtttgagagactgaggcggttggatcacttgaggtcaggagttcgagaccagcctggccaacatggtgaaaccttgtctctactaaaaatacaaaaattagccaggcatgatggcagacacctgtaatcccagctacttggaaggctaaggcaggagaatcacttgaacttgggaggcagaggttgcaatgagctgagatcacaccactgcactccagcctgggtgacagaggaagactccatctcaaaaaaacaaaacaaaacaaacaaataaaagagccatctatcataaacccacagccaacgtcatactgaatggggaaaagctgaaagcctttcccctaaagaactggaacaagacttggctgggcacggtggcccacgcctacaatcccagcactttgggaggccgaggtgggcggatcacgaggtcaggagttcaagaccagcctgaccaacatggtgaaacctcatctctactaaaaatacaaaaattagccgggtgtggtggcacatgcctgtaatcccagctacttggtaggctgaggcaggagaattgcttgaacccaggaggtggaggttgcagtgagccgagacggcgccactgcactccagcctggcaacagagcgagactccatctcaaaaaaaaaaaaaaaaagaactggaacaagacaaggatgcccattctcaccactcctattcaacataatactggaagtcctggccagagcaatcaggcaagataaagaaataaaaggtatccaaataggaaaggaagaagtcaaactatctctctttgcagatgatatgattctatacctagaaaaccacataatctctgcccaaaggctcctagatctgataaatagcttcagcaaaattgtagaatacaaagtcaatgtacaaaaatcagtagcatttctatacaccaataatgttcaggctaagagtcaaataaataaagcaataaattttgagggctagagccagagaagtagtgccttcctccccacttcaccaaacagaagcttgttatggtgattatggtcaatagctagacattgtttaggggctagacatgaaaccctttggctagcagggactcatctcagttacgcccctgtctccagagcagagcagaggcagccgaggtgctatcttgttctttaagacggcagtgaaacagctttgtttcctacctccttgtaaaccatttcatgcctatattgcccaaacttctgatagtccccccaccttaccccctactgtgatcctatttgaactgagagttagatcaatcatcctggggccacagtaatacccatgagtaggtttagatctgatgaggtttatgtcagtgtttctagagagaagacatagaaataggagccatacatccacatataggttggttactctgtgagaggaacataaggggtatgaagagatttgggtttttagacaagctaaattcagaaagttctaagggagacaggcaagtctttttcaagcagtacagctaatgagggccaatatgagcagaggtggtacagggacattctggagctggagtccaaggaagccgggggcatctgagtcagtgggcaggagatgcaaaggaatatttggtcagggctttagggacagacttggggtccagtttgaaaggctcaggattccttgggggctgggaatgttctggagctgcagcaagtctgggcatcaaagtcaagggaacagcaagcaagaactgcatgaagctgatttatgtgatgccgggagtgatggcacatgcctgtaatcccaacactttgggaggccgaggctggtggatcacttgaggccaggagtttgagaccagcctggccaaaatggtgaaccctatctctactaaaaatacaaaaaattagctggacatggtggtacgtacctgtggtcccagctacttgggaggctgaggcaggaggattgcttgaacctgggaggcaaagaggttgcagtaagccaagattgcaccactgcactccagcctgggcaacagaatgagactccatctcaaaaaaaaagaaaaaagaaaaaaggtagccaggcacggtggctcacacctgtaatcccagcactttgggaggctgaggagggtggatcacctgaggtcaggagtccaagaccagcctgcacaacatggtgaaacctgtctctactaaaaatacaaaaattagctaggcacggtggcacatgcctgtaatcccagctactccggaggctgaggcaggagaatcgcttgagcccgggaggtggaggttgcagtgagccaaggttgcgccattgcactccagcctgggtgacagagcaagacttcgtctcaaaaaaaaaagaaagaaaagaaaaagaaaaagaaaaaaacaaaagaaaaatcaagctgatttatatgaaagtctatgtccaagctcaagagagaaatgaaattggacttttaatcatctgcaaatatattgttcccatcctagatctaagttcacggcaataaagaagcttctgcatttcaagtggcattcctccttcaggggatgcagtgcagtgcagaggaggcaataccagggacaaactggttggagaacagcaagggatactttgcaaaaagaatccccctgaccccaacaattcactgaagggtagcaattgaaagttccccatcactcaaaactttctgagggctgcttttcattttcatcattgttggaaagtccttctgtttcactcagcacatttgctcttgggtttttcttgcaggaagaattaactaagcccctgagattgctgttctagcttcattcatagaagagaaatgtgtcagagacagatgagaaaaaatatcagcttggggccccacactctgaggccttctctctctctctttttcttcccctgggtcagtagtgcaaacacttgactacttgtgccccttacacaaaaaagagaataaactattctttagcttattctttagatactgttgtctcccctaaggaaaaagaccctctcacagcataatgtggctgagagtacaaactgcagtagtaggaaaatcatgcttttaaccatcctcagtcttgtagctacttcttaggaaaaaaagctagcatctgggtaaaaggagagaagataatattaaacaaggcacctactatgtgctgagcattagggaggccatttcaatatctaacctcaatgtaaccctcacaagaaatgacagttacattggtagaaatgaggacattgaggatctgagaagtgatgtgacttgtccaaaagtcacatgtttgttgatttgttgatggtggcacagggatctgggcccaggtagtgtcagaccaaagtccaccttcatcccatcagcctgaatctgtgactttctcagtcctgagctatgaccagacatactcgaggaagggggtgtattttaagattcgcatcacccccgcaccttggtggtcagactaatggttcgagatagcaggtgagtaatcataagcagggctgataaggcgttttgccagtatcaagtgtctgggaatatttattattaatcacactaatggaccaccatgagaggacaaagtttctctctggtttttcacctgatagagctggaagcttttcaagcactttccccagccagccaatatcaatttaatttaagtcactatcctcttggaatatgaaattggctccatagacaggatctcccagtgaagtcatcagcccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgtcgtcttttgtgtgcacagtttcatcatctttaactctgcctgacccctgccatcagtcaccaagctctgctctctgtctgtctgtgtgtccttcacagcttcactccatcccatctccactgccagtgccccaggtcagccctccccgactctggcctcaactgttggaacaggctcctccctcgtctccctgcctccaggctgcctgtccaggccagcctccacatggtcatttggtgatcttcatggtgatcttcagaaacatagccttcatgtgtgctcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcacagtgctcatttggcctccctcccacatcctgctttgtcttgtcagcagctgctttttttaattttaattttccattccaggctgggctgtagttgctcccataaagggatcacagtttttgttccatgcagaaggagtccagaacacttctaggcataaccttggagctcatgacaggttgctcagctaggccagagaagagagggatctgctcatttccagccttgcaggcctatcaacttgtattatgttcagtttctctaagggcacacattccccttcacattgcctcaacttatcctgttaggagacaagactaatggaacagattctcctatgtcatcactttctctctcccaactcacaacaacaaacacaatacacacacacacacacacacacacacacacacacacacaggcatagatcttttcagctctgctcccagtctgccttaggtaaacactatactgtgtacaaagaggcatttacaaagacattcactgcaatactataataatcaagggaaacaacataaatgtccatcaccagagcactaattaaatacattatggtatatccatacaataattcagccttttgaaaacacaagctatcagccaggcatggtggctcatgcctgtaatccctgaactttgggaggccaaggcgggtgaatcacctgaggtcaggagttcgagaccagcctggacaatatggtgacaccctgtctctactaaaaatacaaaaattagccaggcatgatggcaggcacctgtagtcccagctacttgggaggctaaggcaggagaacaacttgaacccgggaagcagaggttatagtgagccaaggtcacgccactgcactccagcctgggcgacaagaacaagactctgtctcaaaaaacaaaacaaaacaaaataaaacaaaaaaaccacaagctatcatgaaaagaggtttctgatctattagacctattagaagattcagggagatgtctatgtcttcttctgaatcagacttctgaatgccaagaggcagagctggatcaagtgggagaaagccacagtgggacacgagggagaaggtttgtatagtcacagctgtccaaaactggagagagtcattcaaaaagtactgaggtcctcgtaattgaaagtttgttgacaaaggttacatgaccccatactctgggaggttgaagagaaaatttctatgccctaagggtctataaaatcaatatgtaagaagccctcaaataaaaacagagccattttcaaatcattatgtcattcactaccaagaacatcttaggtaatcagagtgtcaatccatatatgacagataaggtaactgaggctcaaggaagtaaggtcacttggccatgatctcattataagtagggtcttgaaacaagcctatctgactttattattcatcctataatgaaacaagcctatctgactttattattcatcctataatgaaacaagcctatctgactttattatctgactttattattcattcattcaactatctgactttattattcattcattcaacaattttttgtgtgtatgcttactacacaaaaggcactgtactaggctctgtgtatacagacatgaaaaaaacaaaagtttctacccttacagggctcacaacctagtgagggagacagacaaaaaaaaaggaatataatatattttttcaccactccccacatcctaagtgttgaggtatggggataaaagacttcatctcagcagggccaataaaaactattaccctggcataaaaagctcccacctacaacgctctgaaaaaacagtcataggtgactggacaaggaacagaaagcaggatgggtcagggctttgagcagacccttctcctcttactaagacctccatgagagcacaacccaaaaactcctactggccactggtggtgtatatgctttattcatacgtatatgcctttatgtatatatagcaagatagctgcacatttttttttctttagtatatgtatgagggaaagagagagagagaaagtgccaccttgaaagcagtaaattttggaaacagaacacctggttttagtctgtttttccaataactagttcagcaactttaggtaaatcagttgattaacccaagcctcagtttcctgtaaaaattggggtaataataatagctacctcccaatatttttggccaggaggatatataaggttggctataagaagggtctttgcaaggccaggcgtggtggctcgcctgtaatcccagcactttgggaggccgaggagggccgatcacgaggtcaggagatcaagaccatcctggctaatgtggtgaaaccctgtctctactaaaaaatacaaaaaaaaaataaataaaaaattagctgagtgtggtggtgggcgcctgtagtcccagctactcaggaggctgaggcaggagaatggtgtgagcccgggaggcggagcttgcagtgagtggagatcgcgccactgcactccagcctgggcgacagaggaagactctgtcccaaaaaaaaaaaaaaaaaaaagaagggtctccataaaatgattgcatagagccaggtgcagtggctcacgcatgtaatcccagcacactgggaggccgaggcaggcggatcacctgaggtcaggagttcaagaccagtctggtcaatgtggtgaaaccccgtttctaccaaaaaatacaaaaaaatagctgggtgtagtggcaggcgtctgtaatcccagctactcgggaggctgaggcaaaagaatcacttgaacccgggaggtggaggttgcagtcagccgaggtcgcgccactacactccagcctgggcaacaagagcaaaactccatctcaaaaaatacatacttccacatagaaaaagtgtggtcatagctatgtgtatgtggtatataaatgtaggttctggagtcttcctgggcccccagatgtgcctttgtttggccatgtgtatgttatccatacacatggataacatacacatggagcaaacaggctcccatgcttgcctgtttatgtgcccatttgcttgtgtgtgtgttgttcggcctaatctgtatttccaagtcagcctaatgtatagtagccccttcctcccaccacttacgttcctaaaacactttttctcattctttactccctagtctcagaccagaacacattttaacattattttttttctgagaaatacaggcctcaaacattcctaactatttttaagagacttccccctacttcacactacaccaaaggcattggtttatattcagcctagccatgtatttacatgaagatgtgagcccatatgtggctatgtctcagtggggaaaatgcggggccatcccccaggtttgaagtgccccttcaaaccagccacatcatgtgttcctgagcctctccagtggctccagagaatgtggtgttggcaaaataatgccacaggggaagatgagaagccattctccagttttctgtcacacacacaccactcccaactccccagcctccacttctctaagactttgggactgggggccaagaggtctggttctactttctgcaggccaacaaagtcctaaatatactgccatatgactggttccaaagacatccagccatttattctgagtatcagaatgcttgggagaagagagagagccccatgtttaactcatagaacctctgaatcttagagcatggtccttcatcaccgcctaaatccacctctcccatatcctcaatgaaagagtaaaaacagaaatcagaatcttaaaatattacacctttaacatcatctaggctacgtgtcccaattttacaagtgagaaaactacggccaagggaagtgaatggagttggtcaggaaaaagactagttctcctgactcccaggctaggattctttccactgggtctccagactcaagagcaataagaatcaagcaagttaatacaaaagattaatgatcccatgctcctgttgctttgggggacatctgaaaatagaagctgagaagttcttagggagggagaaaaaattacaggggcttgctggtgggtctctctgctgagagcagacctggatcaagtacctaccatggctcagggccagatctgagacccaggagaaatgagagcttctcttgtttagaagctttagaagctgacctggaaactggagaggtcttactcttcctgtgacatgggttctggatctccaacaaaagctcctaaaggcaaggattgtggcttgcattatcttctcatctcccaaaaacttgtccagctccaggcctcctgattgattgatgatgcttgccatagagatgaaatcatcctggctctgtgggcaaaggtctctgtcctgattaaccctcagactggctgcatcactgaactgcaagtgcaccagccttccggtgctccacattctagttgcccccatcttccagggggctggattagcacagcacatcccaagggtcatgggcttgcctgctggcctagggaggttgcttcccatcctcagggctctgacctcatagactgcacaggggatgaaagtagaggctggtcttgaacttctggcctcaagtgatccacccacctttgcctcccaaagtgctgggattacaggcgtgagccaccatgcctggcctgggatggtgttaatatgactagagggatgtctgatagaagggaaacacagcaagtaaagagcaactgaaaggccgggtgcggtggctcacgcctgtaatcccaacgctttgggaggccaaggtgggtggatcacctgaggtcaggagttcgagaccagcctggccaatgtggccaatgtgatgaaaccccatctctactaaaaatacaaaaaattagctgagtgggatggcaggtgcctgtaatcccagctactcaagaggctgaagcaggagaatcgcttgaacccaggaggcagaggttgcagtgagctgagatcgtgccattgcactccagcctggacaagaacagcgaaagtccatagcaaaataataataataataataataataataataataataataataaatattacttctttccttgcccatttttactaaaatagaatacatcccccacaaaaagagcaccatattctcaatctcagagatttgtttccttcacagcacttatagtttgaaataatgtattttatctgtgtatttacttgtttaatatctacctccctgtagtagacagaaaaatggcaccctgaacatacatatccatatcttaattttattttctttctttctttctttttttttttttttagatagagtctcactctgtcccccgggctggaatgcagtggtgtggtcttgtatttttggtagagacagggtttcaccatgttggcaaggctggtctcaaacgcttgaactcaagtgatctgcctacctcagcctcccaaagtgctggaattacaggcatgagccactgcacccggcctctaattttcaaaacctattaatatattatgttacattacaaagaggaattaaggttgcagatggaattaaggtaactaatcagctgaccttgagatgggaagattatcctagattacccgcgtgggcacagtgtaatcacaacggtctttataagtggaacagtggaagagggaggcatgagaggatgtcagagtgatgcagtgtgaggatttgacctgctattgctggctttgaagagagaagggaccataagccaaggaatgcaggcagtctcaataagctggaaaagacaaggaaatttattcttctctagagccttcagaaggaactcagccctgctgaccattttaaacttctgacctccagaactgtaagaaaattaattgttgttttaaaccactcataatttgttacgggacacatggtaaactattacactcccccattagatcatgattttgatgagggcaggaaataggtctgttctgctcaccatcatagccccagcatacattgtagcacccagcacagagtaggacctcaattaatattaggttaaataaatgaatgaatcttgggcatgccttagggatcctgcctccataatgccccttaatgtggggtgccatttcatccaaggggctgagcccaaaggaggctggcacctccccagccagaacgtggtaggagagaagctggaagcctgagaacacatacatcttttatttctcagaaaaggaacccttgatggctgggtgcagtggctcatgcctgtaatcccagcactttgggaggccaaggggggtggatcacttgaagccaagtgttcgagaccagcctggccaacatggcaaaaccctgtctctactaaaaatacaaaaattagctgggaatagtggcatgcacctgtggtcccagctatttgagaggctgaggtgcaagaatcgcttgaacccaggagggggaggttgcagtgaatccaggagggggagtttgcaggagggggaggttgcagtaccactgcactccagcctgggtgacagagtctcactctgcctcaaaaaaaaaaaaaaaaaaaaaaaaagagaaaaaaggaggcctgtggagtctatattaaccacctgtctatccacacaacaatgtgcacgttttttttttcatacctatatatacagagaaatgatgattctcattccagaaccttttctggagcacctagtgtgtgtcatgtgcagtgccaggagcttgtgcgtatgttatttgtggatggtggtggtagtggtctgtttcacgtgttatttttttgttatctcatttgttccttgctttggtggggtagggattcctagtcctactatgaaaaggcaaagacaaagtatgagcccagctcaaggccacatagccagtgagctggaacccagctctccagacagacactgtacccaattttatatatatatacacacatacacacacacacatatacacacacatacatatacacacgcgcatacacacacacacacacacaaatatatatatatatattttttttttttttgagatagagtctctctctgtcacctaggctggagcacagtggcatgatctcggctcactgcaacctccgcctcccgggttcaagcaaatctcctgcctcagcctcccaaggagctgggactacaggcacccgccaccacgcctggctaatttttgtattttttttttttttttttagtagagatggggtttcatcatattgacaggctggtctcaaactcctgaccttgtgattcacctgcccctgcctcctaaagtgctgggactacaggtgtgagccacgggctcctggccatagatatatatatatatatatacatatatatataaatttttttaagctaccacctaccagcacttctccctcacacacaaggttgtacacattggacccatgttgtctcttcccttaggccatatcttgagcagtctaccttcttctccctgctgaagtaatacactctgcctttcggcaaccatttttcctcccagtaaaaagaagtagtaagttgagtagaaaggtcacaggatttggcatcccagcctagattcaggtgttcacttggccacttacggacagtgggatctttggcattttctcctcatccatacccaggccttacctctcatttccagtcacatcttttttattttattttattttattttattttatttattttatttattttattttattttattttaatctttgagatggaggctcacactgtcacccaggctggagtgcagtgtcatgatctcggctcactgcaacttccgcctcccaggttcaagcgattctcctgcctcagcctcccaagtagctgggattacaagtgcgtgccaccacgcctggctaatttttagtagagacggggtttcaccgtgttagccaggatggtcttgatcttctgacctcgtgatccacccatctcggcctcccaaagtgctgggattacaggcgtgggccaccacgtccagtcctctcttttatttattttttatttttacttttatttttgagacggagtctctctctgttgcccaggctggagtgcagtggcacgatcttggctcactgcaacctctgcctcccagattcaagcaattctcctgcctcagcctcccaagtagctgagatcacaggcgcccacgaccacgcccggctaatttttgtatttttagtagagaaggggtttcaccacgttggccaggctggtcttgaactcctgacctcaggcgatctgcccacgtcggcctcccaaagtgctgggattacaggcgtgagccaccgcgcctcccaaagtgttgggattaaatgcatgagtgaccactccaggcctcaaaaacccttctgatcattcctctcctcaaacttgtccccttccagagatctaagagtcatctttaatatcttctttttcctcacgccccccccaccccctccagccatttcaacccactgctaagttctatcaatgagccattctaaaaactttcaaatctgtctgcttctctctatgtccactgccactaccctggtcccagcccagtcgaatggacaactacatcaggttcctaactgattttcccacatcctttttggctctcctccatccatttgtccacaaagaagccagagaaatattttcaatatgcaaaatcatgtcattctccagcttaaaaaccttcaatggcttctcccctgtgcttttatgatgaaaagaatcgttgtcatggcctttaaaaggcatttatggtatggctcctacctatttctctagcctctctctaccaactctctctgtcactgcttgcattccagccacactagccatttttccatctctaaaatgtgttatgcttcctccaatccatcccccatgaaggtctttgcatactatgcattctgcaggggagcacatgtttccccaccttcaccatttacctagttaacaccaattcaatccttcctttagatcaaatatcactacttgtggaactctctaaaacccaccatatgtcaggatccctaccacatgtccttagagaactaaccacctggctgggtgcagtggcttacgcctgtaatcccagcactttgggaagccgaggtgggcggatcacgaggtcaggagttcgagaccagcctggccaacatggcaaaatcccacctctactaaaaatccaaaaaattagctgggtgtggtggcaggcacctgtaatcccagctgcttgggaggctgaggcaggagaattgcttgaacccgggaggtggaggttgcagtgagccgagatcacgccattgcactccaacctggatgacagtgcaagactccatctcaaaaaaaaaaaaaaaaagagatagagcaaactaaccacctttcctccatagaacttactaacttactacagtttgcaaatatacaattatttgagtcttgagttgattaatgtctgtctccccaagtaaaccataagtttcattaaggcaggaacagtgtttgctttttatctctattgaaaaccagtgtctataataagagtgaatgagaggtggtgaattcacaaagggccttgtacctcatactagggtttgtttttttgttttgttttgttttgttttgagatggagcttcactcttgttgcccaggctggagtgcaatggtgcgatctcggctcaccacaacctccgctccccgggttcaagagattctcctgcctcagcctctcgagtagctgggattacaggcatgcaccaccacacccatctaatttattgtatttttagtagagatggggtttctccatgttggacaggctggtcttgaacttccgacctcaggtgatcagcccgccttggcctcccaaagtgctgggattacaagcgtgagccaccacgcccggccatactaggggtcttgaatgttatcctcgggataatgagaaactgcttatagttttaaagcagggaagtgacttgatcaggtttttgtttttagaaaagataatgtcacatgccaaaggaagacagaattgaggggatgagatgagatgggggatatagaactcagtttggaagccattgtaacagctcaggcaaaaaataatgaggatgtgagctatgttatcgttatctcctctgggccagctatctctcaactcattcatctctcaactcattccacaaatgatttgaagtaactcaccacaagaaagcaataaaattgtaaaattaaataaacacaactttaaaatcaggatgagagaagtgaagatcaggaagttaaaactgaggaaccctgttgaggggagaaatgaaagaggagaaattattaacaatagagtacagacatggaagccacaggtcacatgcaactgagctgtgaaaagggacacccagtttttattgaacaaaaggaaaagatatactcatgcttcagttatggacttggatggtagtagaggttgaatattcattatccaatatgcttgaaaccagaagtgttttgaaattatgatttttccaaattttggaatatttgcattatacaaattgagcatctctaatccaaaaatccagaattcaaaatgcttcaaaatctgaaactttttgagtgccaacttttcggattagggatactagacctatattagaaatggggagaagaggataaatttgagggattaaagaggtattacagaacagataggaattagtgattagaagccctataatagtaccaacttgcggagcagaaggaagagaatgaagtttttggacatggtgaatttgaggtacccatgaaccatcaaggtggaggcagctgggcagttttatctcaatgtttcctccttcatccctgctctgtttcacctcaccaagcgtttcctctatgttggagccacacctaagcatttccacatagattcaaagttctgtgtctttgagccttctgctcctcagttttataatctttttccacttgaccaactcatactcactcttcacaatacaagtcaaatgtcattttctgagaaaagaaaagctgtccccctcaccaccacccccgccccgcctacagaaactccctttcttctctgtgcccccgcaatgctttggacactcaactcccgacaaacatgctttagggaaaatccatgggagcagaaagaaaggaaaatctgtgctatcgagacctgggagtaggagggttcattacatgaagcccagaagagaggtaggaaaaactccactgatacagatgagagcaataatcaaagcagagaccttgagggatgcattgtcagaggccagctatcagctatcagaagcgaggagggtcctgatagctccaggctcagagcagcctgggaagcacacttggggaaggatagcctgaaggcctgccagcctaggcctggagtctacatggctcagcctaaaccaagcccagacaggggagggtggggctgggcctcctcccagcccagtagcccagggatgactcagggcttggcatcagctccagtacttggcagtttgtgctagaagagtgattgttagctctgttctgagattgggggtaactctaacttttccattgtttttaaaatccccctctgtttgccctggagttatgagtggctatttaaatcccttcatggtgttctgacacctacagggaaaagtccaaattccttaacagggcatatatgatcagtctcatctcttgtcccatcaccctgctctccagtaatcccaagccctggattggactgaaaagccatgttgtctgcctcctctgggtcattggacatgtttccactgcctagaatgtcattcccctaatggcttcccccacttaccaggagaactattacttttattctagtctcagctcacctcatctgagaagtccctgaccatagctgcttcctcagtctgaatttgattccccctgccctgagctgccactgtcccttgagcttccttttttctttgtactcaaatagtatttgtgggataaataaaacataatgtcctttttatgggattatgggggtcagagaggtggttggtcagtgatacgcagttctgagacgacggagctgggcataatgatgtgctaagtttgaaccccagctctgccactaataaactgtatgatcttgaatcagttattttacctctctaggcctccatctttccatctgtttgatggtgggataggactaagaagtgtctatggtcccttccagctctgatatcctaggatttaggggaaaaggtaaaggaactcatgggagagaaggaaagaatatatgaaagccagcctaccaccacaaaggatgttacagatttaattggcaagcatcctgtgaccttttcagcctggcaggtactgcttattatttataacattccatcctgaagtgctatacatatcactgagcccttttgctaatgttattccattttgcagcagccagtgagagaggcagaacaaggatttaaaagctggccccattttacagaagagaaaactgagggagagaaaaaagtggttgtcccaatcagtgctcaaataacttaaggtctaaatacttgcagtcaccctgtgtagggtgaccaacatttccagtttgctgggaatgcagaactttccgtttcaaaaccaggaaagtcccaggcaaaccagaaagttaggtcaccttacataggtaattagctttccagccctcaatcacccttgagacaatgggttgtagccagggagcaatggagtaataccataccttcccagtgggtcccacctgacaggggaccaagaagctaatccagcccctttttcttctccctcaaactagattacatctaactaggcttctcttggtttagtgattcatagccctgcctgcacattagaatcacttgggaagttttataaaaacaactatatctggacaccaccccaggccaattaaattagaactttctagcttgagtacagttgctagaactttctagcatcaatatttttaaaagctctctgggtgattcgaatgtgcgctgggcctaggaactatggagcctagctggttctaagatttaaccacagagtacttgggcccttgaatagaaaaacccctccccaaacgtctcctcccactcttgccttgcccagcctcccagcctacaaatcttcctctagacactcagaagcagtcctgtgcagaatacagaagcccttccctacccctcccctttcctggcagcttaaggtgatcctcttcccggaatcattggcatttttgcaaaggaattttggaaagcattcaagattcaaagtacaaagcactaatgaaaaatcagacattggggaggtatcttgaaacaagggaataggtctagtgcccttgggaatcacaccacctaggtaaccacctacctattcaccctaataacagagccaatttaagctctctgactcagaagaagggaagaggagggaggaattctaatctaagggctagaagacctgcagtttccacaggtcagatgctctgagataagggagaagcgagtgggatggggtggctagggaggggagatctctctgaggggataggggtgggaagctaagctgactggcctttgctctaactcacagcagatcccattggttttttttccctgaggcccctgcccttgactttcccatcagcctcaggcaggccatgcacgtccacatttgtcaagtctgagcctctcaaaaactagaaaagaatggactcagaggtcatctaactccctgaccatctccttacacaccttcagtgatgagaagctcactcccagtccctagctagacagcctactcaatcacaggagagctagggattcaaagagctgcatttatataagtcaaaatcagtttccctgagatttacattctctctggcccagatccttcaactgtttccctgacttgagttccactccctctcagcctacttgcttccctctggacagactccagtttgtcacttgtttgtgtgacttgtctatgacttgtgtcgctttgtgtggtatgccatgcccaaacctggaccctggcggactctgcccaatgtacctcctttcttccaaaataatatatttattagtataatccaggataacacacacacacacacacacacacacacacacacacaccataatgtacactctacattctggtttataacctgctttttttcactcaacagtattcttgggcatctttgcatgccaattaatataggtctatttcaccattttatgtggcttcatagtgtttcattgcatggatgtattatagtttatttaaccattctgctaacaaaggacactgagttgttttcgtttctttcttttttttttttttttttttgagatggagtttcgctcttgttgcccaggctagagtgcaatggcacactctcggctcaccgcaacctccgccttctaggttcaagcgattctcctgcctcagcctcccgagtagctgggattacaggcattcaccaccacacccagctaattttgtatttttggtagagacagggtttctccatgttggtcacgctggtctcgaactcccaacctcaggtgatccacctgccttggcctcccaaagtgctgggactacaggcatgagccaccgcgcccggccaacactgagttgttttcaattttacactatcaaacaattttatgataaataaccttaggcatatatttctacacgcttagctatatttattcctcagtaaacaaattttaaattttgatacatgatttcagtctccagagacagttttctagcttccatttccatgagaaatggatacaagagctattatccccacatgctcatcaacacttggtatcatcagtcattttactctctgtcaatatgctaaaatatatatatatatatatatatatatatatatatacttcactttttttttttttttgagaccgagtctcactctgttgcccaggctggagtgcagtggcgtgatctcggctcactgaaacctctgcctcccaggctcaagtgattctcctgcctcagcctcccgagtagctgggattacaggcgcacacctccatgcccagctaatttttgtatttttagtagagacggggttttgccatgtttgccacgctggtctcaaactcctgacctcaagtgatctgcctgccttggcctcccaaagtgctgggattacaggcgtgagcaaccacacccagcctatcatttgtcttttgaatttgctttaacttttgcaacacaaaataatttttattttacatttatgtagtcaactgtaccactaaaataatacttattttattatttctgtcttatgccaagatttatttatttatttatagacagattcttgctctgtcccccaggctggagtgcaatggcgcgaccttggctcactgcaacctccgcctcccgggttcaagcaattctcgttccttagccttccaagaagctggaattacaggcatgagccaccacgcccagctaatttttgtattcttagtagagacagagttttgccatgttgcccaggctgatctgggactcctggcctcaagcaatctgcccacctcggcctctcaaagtgctgagattacagatgtgagccactgcgcctggctctgtgctaagattataaaattattaatacatatttccttctagtacatttaggctatcatacctttcctcctttctctgccctccatcagaactcaccatctgctacccactcccctctgcttcctactagactgataaattaaagctgataaactgagatatgataatatcaggccacggagtatgctgttctgatattttaatagtgaattattggagaagctagtgttatcccacagaagtatctctctaacggtgacattttgtttgtttgttttgttgagatggagtctcactcttgttgctcaggctggagtgcaatggcactacctcggctcactgcaacctccacctcccaggttcaagcgttctcctgcattagcctcccgagtagctgggattacatgtgcctgccaccatgcccagctaatttttttttatttatttttagtagagacggggtttcactatgttagccaggctggtctcaaactcctgacctcatgatccacccaccttggcctcccaaagtgctgggattataggcctgagccaccacgcccagccaatggtgacattttgagtgctgaaacaggaacgtgagggaaatgatttggaggcagcagattcagggaggtggggtggtgtaatggaaagtgtatcaagtttaaagatgaacaaatctgcattttgagtccccacactagctgtgtgatgttgacaatttatgtcccctcctaagaccccctttctttatccataaaataagaagactaccatgtgttctttatgattgtcacctgtttgccatgtgtgtccttcctttctggtctcattcactggggcacccctagcatctagcacagcacctggcagatagtaggtgctcagtaaatgtttataatctgaattaatggatacgtgagaaagtagctggcaaacagtaagtcctgtgtataatggttcccgtgcttaccttccctctcagaatcctcccagatcaggcctagccttcagctacctctcatgaaaggaagctcttaaatttctactccctccgacatcaaatagtaagggactgccttctgcttcctgattaagatgttgaggtagccaagaatccctgtactaaggaggatctggaggcaaagggggacttcactctgtttcccttggtggagcaggtcatgctgtccaggaggtgccagtcttctctaagagcaacacacaatacccacatgctggcttagaaaccaggaaccctggagtccacacccttcccacttccctggcagacagcaaacctccaatttgggagattccgatttgggttctggctctttcgcttatttaccctgcaaccttagaaaatgagctttcaggccaggcacggtggctcacgcctgtaatcccagcactttgggaggctgaggcgagtggattacctgaggtcatgagttcgagaccagcctgggcaacatggtgaaaccccgtctctactaaaaatatgaaaaattagctgggtgtggtggcgggtacctgtaatcccagctactcagaaggctgaggcaggaggattgcttgaacctgggaagcggaggtcgcagtgagccaagatcatgccattgcactccagcctgggcaacaagagtaaaactccatctcagaaaagaaaaaaaagaaaatgaactttctcttttctggacctctattgattcttctgaaaaatgaagcttataatacctgccctatttccctcaggaggagccaggaggagcaagtgagatatctaaaggtccacaaatttgttctagcatgcagagttatttcattgcatttttaccataacaccttgcagtgagtatcatgatgcctgtattacaaggtatgtaactgagacacaggaagtgaagtaacttgctgaagatcacactaggaaatggcaaaggtggattcatatccaggtttttctggcagggtgtggtggctcacacctgtaatcccagcactttgggaggctgaggcgggtggatcacttgaggtcaggagtttgagatcagcctggccaatatggtgaaacgctgtctcttctaaaaatacaaaaaattagcccagcatgggcgcacacttctaatcccagctacttgggaggctgaggtgggaggatcacttaaacccaggaggtggaggttgccatgagctgagatcgtgccactgcactcagtctgggtgaaggagtgagactttgtctcaaaagaaaaagaaaaaagaaaaaaaccaaaatccaggtctttctgattacagctgctcctgctaaatgccaggtactatgctaggaaccgcagatgccaccatcaataattcctagtccttcaaggtacttacagtttagtaggggaagcagatgtataaatatactatcaaggcccagagtgataaatacaatggcagaaagcagaaatgctatgggagagtggaagggaagcacaaaaagatggagcttaagcaaatacttaaagagtgagcaggagttctccacatagatcacagtgagaggaattcattctaggcagagggaccagcatgtacagaagccaaaagtatggcagcacacatcaagtacaaaatactgttctaccaaagaaagggcaagcaaatcaaatgattagagtacaatctagaagcaatctgaaatatgtaacagaatttgtggttatcacctgttgaattttacgcaatgaatatttttattgacaatccatgatctagcaggtactctgtcatgtactggggagatagccatgctgaaaaatcactaccatcatggaacttacattctagtgggggaagacgggcaataaacaagtaaatcagtctaatgtatagtatgttagatggtaataagtgctaaataataaagcagagaaggaggtgtggaggacgttgcaaatgtagacaagaaaggtcagcgaatgcctcactgaaaggtaacgattcaatagaggcatggtggttcacacctgtaatcctagaactttaaggaggccaaggtgggaggatcgcttgagcccaggagtccaagaccagcctgggcaacatagtgagaccccgcctctattaaaaaaaaaagaaataaatagagacatgaatgaactgagggaagaagcaagatatctggtaaaagagaattctagacagagaaattaacaaaggacaaaggttctaaggtggagctcatatgttctaggaacagcaaggaggctctttatgactggatcactgtggggtgggggttggggacagagaatagtaggagattaagtcagagaggtgggaaggtctatctttggataggagtagggtgtggaaagcttaaagagttttacttttcttttctttcttttctttttttttttttttcttaagatggagttttgctctcgttgcccaggctggagtgcgatggcatgatctcggctcaccgcaacctccacttcctgagttcaagtgattctcctgcctcggcctcccgagtagctgggattacaggcatgtgccaccacaccgggctaattttgtatttttagtagagacggggtttctctatgttggtcacgctggtctcgaactcccaacctcaggtgatccgcctgccttggcttcccaaagtgctgggattacaggcatgaaccaccacgcccggcctaatattcttttctttcttttttttttttttgagaccgaatcttgctgtgtcgtccaggctggagagcagtggcatgatctcggctcactgcaagctccgcctcctggtttcacgccattctcctgcctcagcctcccgagtagcggactacaggtgcccaccaccatgcccagctaagttttttttttttttttgtatttttagtagagacggggtttcaccgtgttagccaggatggtcttgatctcctgacctcgtgatccgcctgcctcggcctcccaaagtgctgggattacaggcgtgagccaccgcgcctggcccttcttttcttttctttctttctggtttttttttttttttttttttttttttgagatggagttttgctcttgttgcccagcccggagtgcaatagcgagatctcggctcactacagcttccgcctcctgggttcaagcaattctcctgcctcagcctcctgagtagctaggattacaggtgcccgccaccatgcccagctaatttttttgtattttcagtagagacaggatttcaccatgttgccctggctggtctcgagctgctgaactcctgacctcagatgatccatccacctcggcctcccaaggtgctgggattataggcatgagccaccacacccagcctgcttttcatttctctatgctgtttgaatttctacctgcaggcatgtgagagaggacgagacaaagaggaaagaatgtcagtttgggagagtggtagagagtttggaaggttctaaagggaaacatagcaagtaagaaagaagtttgaaaaggtgagtgggggctaaatcacaaataggcttatgtttcaggctaaggggttttggattttatccactaggtagtgggaaactagtgaaaacttgaagtagaagtgacacagtcagggctgcctctcccctgcaccccacccgaaaatatgataggtttatctgtccagtatagaagctagattgcccagggagaaactggaggcagagaaaccaagctgttgcaacaatccactccagagagagtaaactagggcagagatgaaggaaatggatttaagagattcttttttctcccttccttcttgagagatattaatagtgccctctctggtcttcacatataaatatttaaggagtgatattaatagcgccctctctggctttcacatataaatattgaaggggtgatactagctgacctttaggatcccttccagcttggatactttggggtcttgggaattgaggcacatgttattcatcccttcccactttctggatggctcatgatctgctgctactactctcttctcttccatgatgtcccaatctggggacagcgttactgttgttttgtcagtggctggtggaagctaaggaagaatacaggacaggcttcagttatgctatcttcagtgaatcctctggcatcccagactgaatggaggggatagacacgccttctgggatattttgaaagcttccaaaaatagcctcaaggcctcagtcagagagtgtagggctgggactgcattggaactcacagtctttgccaagttcccaccccagtctccgtcccctgactgaataaaccagctttccctcctttttccttaactgtctgctggagggcccccacccaggcctgaaaagtttaaatttagccctaagtcaccatttctatctcttctggagagagagcccaggatataacagcttaccctctgtaaaggtccctgtgggctctgggatgggaaagaaaatgagacagacaaagacagggagaggttgagactgagacacacacccatagacatcaaaaaacaaaaggagagactggagtatgggtaagagagagaagaaaagacaagaggcagagcaacaaacagaaaggataagacaaaaggagaaacagtccaagagactggggcaaagaaggagaaatactaagcaataggaaagaatacagcggacaagaaaaaaaagagatatgggaaaaagtatacagagtcagagacaggcagagaggaaaagggagagtaggagccataaagacagaataaaaaaggagcctcaattatttgtcctgccctaaacccttgcatcaggccaacagcctgggctggagggttgggctgagccctgggagtggtccctgtggagtccagtgtccgaggggtactgacagggctcccaggggccataacagacagaaggccccaaggtacgtgagcccaagcagcagtgagcccaagtggatcaggcactcacatccaccatgtactgcagatgtgtagatagtcaccctcaaacaagtgcgaaaaaagctagtccccaaaatgagaatactttcctatctgatatttaaaaacattttatattagtcatcatgaaggtgatcagaatattaataaacttccttgtgctgatttcaatggcttttttttattttttatttttattttattttgagaccgagtctggctctgttgcctaggctggagtgcagtgttgcgatctcggctcactacaacctctgcctcccgggttcaagtgattctcctgcctcagcctcccgagtggctgggatgacaggtgtgtgccactgggcccagctaatttttgtatttttagtagagacagggtttcaccatgttggccaggctggtctcgaactcctgacctcaggtgatccacccacctcggccacccaaagtgctgggattacaggcgtgagccaccgcacctggccttcaatggcttattgttgtttttcttttgcattacatacagacgggagcatcacattctgttcctcttctagggcctctaaagccttaatctggccctgccaccatggctctgggttgcagtgcagggtgaagggaaggacatgcccccctcctgggcctgtttcaatggctctctgactgttcttctcagtcctctttgccaggccaaggattcttgggtccctggacagcagtagattctttttagcatgaaactgtcctttgtggtgtggtggttgggtcatgggagctagtcaggggaaacaaggagatgagtgaaaggaattgataaagaaggtgaagaaggggatgtggtctggtggtaagacactggaccgagtaagttcaaggccatactctgctcttgaactgatgtgtgacattggacacatgaccattcttctgaaacacagcctctttcttaataaaatgagactaatatccatcatgttagggttctcatggcatttctgtgagaatgaactatcgaaaaatacaagtgtgagaaaggttccttcctattattacaaatacctttagagaatgttagaccattgaaggctgacatgcttcctgatacagatgaggcaactaaggctcagaggaagaagaggctggcccaagggaacacagcccagtttacagcggaccagtccgagaatgcaagtttccttatcaggccaaagttttctgaatttcactagagcagggacaaaggagagagcaggaaagcctgtgagaggcctggggaaatacaggtcacactggggcagtgaattaaagaatggaaatctgggatctgggtttattgtcttaatcagaactgagatgtgattaattaagtgtttatggccatgtttgtgctttgtttggtggtaggttagagaagaattgtaaatatgcctaatgcataaagagctttttataacagaagcccttgaaaagggagcatgccagcctaccaagggtcccatgaagaagtcacctcctttccagtgggcatctgggcagaaatttctgaagaaaaggggtgcaaaaaaagtctccacctcggtcagatatcacccttggggattctgtggctctccaatgtctatgggggtaaagtctaaactctttttttgtaacaagtaggtccttgcttgatccctcacaatgtcctccccagctacatctctggcttattcccactactacctccctaacctacagccatattaaatctgtggctaccataatatgccctttctgtcctctctgcctgaaatgaatccatgccagccctccctttgcttagctaagctaacttatccttcaaggcttagctgaggattacttctcctgagaaatcctccctaatgatccttcatcttcagtctggagtcccatattttttggatcatgactcctccatttagcaatctggattaacattatttgtttccacatctttgtcttccacgagataataactactttgatggcagggaccatgtcatctccatctatgtagtaataattatagctaacatttatctagctgtgccagacactttatacacgtgaaccttcacgagtcccactgaggtaggtactatatgcccaagtcatacaaagagacatcactacacagctatcagaatggctacaattaaaaaaacagcgacaacaccaacgatgtgaagaaatttaaggaactgaatcagtgaaggatgtgaagaaactgaatcactcatacattgttgttgggaatgtaaaatgatacagtcattctgaaaaatagtttggtagtttcttataaaactagaaatgcagctacagtgtgacccagtatgtcttagtctatttcattctactacaacagcataccacagattggatcatttataatgaacagaaatttattgactcatgttttctggaggctcgaaagtccaaaatcgagaggttagcatccggcaagggccttcttgctgcatcatcccatggcagaagagcaaataaagggtaaggaagagacggtaaaagggggccaaacttccccttttataatgagcccactcccacgataacagcattaatccattcactccagcctcatggcttaacaatctattattaggccccacattccaacactgttgcattaggggttaagtttccaacacatgatttttgggggacacattcaaaccatcgctcagtaactgcatatttaggcatttatcccagagtattaaacatttctgttcacaagaaaacctgtacaggaatgctcataactgttttattaataatagcccaggctgggcatggtggggtggggtgggtcatgcctgtaatcccaacattttaggatgctgaggcaagaagattgcttgagcccaggaatccgaaacgagcctgggtctttagtttgattccatgtctacaaaatataaaaatgaaaaaatcagccaggtgtagtagcacatgcttgtcccagctacttgagaggctgaggtgagaggatcacttgagcccagaaggttgaggctgcagtgcgccatgatcatgcgactgcactccagcatgggcaacagagtgagaccctgtctcaaaataaagtaataataatagcgccaaactagaaactgcccaaatgtccttcagtgggtgaatggataaacaagctgcggtgcatcaataacatggaatactattcagcagtaaaaaggaatgaactattgatataggtgacaatttggattaactttaaaagaatcatactgagtgaaaaaagtcaatctcaaggattacacattgtaagaatccattcatataacatttttgaaaggacaaaattaaatgcatggaaaacagaatagtggttgtcagcggttaagaaggatgtagggggctgggcacggtggctcacatctgtaatctcatcactttgggaggccgaggtgggcagatcatttgaggtcaggagttcaaaaccagcctggccaacatggtgaaatcccatctctactaaaaaaacaaaaattatccgggcatggtggtgggcgcctgtaatcccagctactcgaagctgaggcaggagaattgtttgagcccgggaggtggaggttgcagtgagcagacatggcgccattgcattccagcctgggcaacagagcgagactctgtctcagacaaaaaaaaaaaaaagaagcaggatatagaggtagatgggaggtaggtgtgactataataggacaacatgagagatctctgtggtagtgaaaatgttctgcatcttgactatatcgatgtcaatatcctggttgtgatattacacaatagttatgcaagattttatgagtgcaggtaactgaggaaaaatgcaggggactatagtatttatttcaactgtatgtaaatctactattatctcaaaattaaaatttcaaaaaatttttaaaaggaagtattgacacatgatatgatatgaaccatgcaaaattgtaccaagtgaaagaaatcagtaacaaaagaccacaaaatgtatgatttcatttatatgaaatattcagaaaaggcaaatccatagagatagaaagtagactagtggttgcctagcgctggggtaaggagggtgaaaggaatgggagtgactggtaaaaggtgcagggtttttgagggtttttgtttgtttgcttgttttgttttgtttttgaggcagggtctcattctgtcacccaggctggaatgcagcggcacgatcatagttcattgcatcctccagcccctgggctcaaaagatcttcccacctcagcctccccagtagctgggattattacaggtacataccaccatacccagctagcattttcttttttgttttattttattttttaacaaatggactctcactatgttgcctaggctggtttcaaacccctgggctcaagtaatcctgcttcagcctcccaaaatgctgggattataagtgtgaattactgcacccagcctttagggtttctttttagggtgacacaaatgttttacattttgatagtggtgatgattacacaactcagtgaggacactaaaagccaatgaattgtacactttttttttttttgagtcaaaggctcgctctgtcacccaggctggagtgcagtggcacaatcttggctcactgcagcccccgcctcccaggttccagcgattcttgaacctcagcctcccgagtagctgggattacaagcacccaccaccacacccagcgaatttttgtattttttgtagagacagagtttcaccacgttggccaggctggtctcaaactcctgacctcaagtcatcggcccacctcagcctcccaaagtgctaggattacaggtgtgagccacctcgcctgagtgaattgtacactttaaaagactgaattccatggtgatatggtttggctgtgtccccacccaaatctcaacttgaattgtatctcccagaatttccacaagttgtggtggggaccggtgggggtgtaatttaatcatgggggcgagtctttcccacgctattctcatgatagtgaataagtctcacaagatctgctggatttatctggggtttctgcttttgcttcttcctcattttgctcttgccaccaccatgtaagaagtgtctttcacctcctgccatggttctgaggcctccccagccatgtggaactgtaagtccaattaaacctctttctcttcccagtctcgggtatgtctttatcagcagcatgaaaacagactaatacagtaaactgataccagtagagtggggcactactgaaaagatacccaaaaatgtggaagcaactttggaactgggtaacaggcagaggctggaacagtttggagggctcagaagaagacaggaaaatgtgggaaagtttgaaacttcccagagacttgttgaatggctttgacaaaaatgctgatagtgatatgaacaataaggtccaggctgaggtggtctcagatggcgatgaggaacttgttgggaactggagcaaaagtgactcttgttatgtttcagcaaagagactggtggaattttgcccctgccctagagatttgtggaactttgaacttgagagagatgatttagggtatctggtggaagaaatttctaggcagcaaagcattcaagaggtgacttgggtactgttaaaaacattcctttttttttttttttgagatggagtctcgctctattgcccaggctggagtgcagtggcatgatcttggctcactgactgcaacctccactttccaggtttaagcgattctcctgcctcagcctcctgagtagctaggatcatagatacccgccatcacgcctggctaattttttgtatttttagcagagacagggtttcaccatgttggccaggctggtctcaaactcttgacctcaggtgatccgcccacctcggcctcccaaagtgttaggattacaggtgtgatccactgcacctccccaaaaacattctgttttaaaaaggaaacagcataaaaattcagaaaatttgaagcctgatgatgcagtagaaaaaaaaaacattttttttaaggacaaattgaagcttgctgcagaaatttgcataagtagcaaggagcctaatgttaatccccaagaccatgggggaaaatgtctccaggccatgtcagaggtcttcactgcagcccctcctatcacaggcccgaaggccgaggaggaaaaagtggtttcgtgagccagccccagggtccctgagctgcgtgcagcctagggacttggtgccctgtgtcccagccactccagccatggctgaaaggggccaacgtagagctcaggctgtggcttcagagggtggaagccccaagccctggcagcttccatgtggtgctgagcctgcaggtgcacagaagtcaagaattgaggcttgggaacctctgcctagatttcagaagatgtatgggacctggatgcccaagcaaaagtttgctgctggggcggagccctcatagagaacttctgctagggaagtgcagaatggaaatgtggggctggagcccccacacagagtccctactggggcactgtgaaaagtgggccaccgtcctccaggccccagaatggtagctccaccaacagcttgcattgtgcacctggaaaagccacagatattaatgccagccaggagggaggctgtaccctgcaaagccacaagggtggagctgcccaaaaccatgggaacccatctcttgcatcattgtgaactggatgtgagaactggaatcaaaggaggtcattttggagctttaaaatttgaccaccccactggatttcagacttgcatgggccctgtaacctccttgttttggccaatttctcctatatggaatggttgcatttacccaatacctgtactaccattgtatctaagaagtaactagcttgcctttgattgtacaggcttataggcagaggggacttgccttgtctcaggtgagactttggactatggacttttgggttaatgctgaaatgagttaagatttttggggactgttgggaaggtatgattggttttgaaatgtgaggatatgagatttggaggggactggggcaaaatgatatggtttggctgtgtccccacccaaatctcaatttaactgtaactcctagaattcccacaatgggacccagggggaggtaattgaatcatgggggccggtcattcccatgatattttcatgacagtggaaaagtctcatgagatctgatgggtttatcaggggtttccacttttgcttctctctcattttctcttgccactgccatgtaagaagtgcctttcgtctcctgccatgattctgaggttgccccagccatgtggaattgtaagtccaattaaacctctttttctcgacagtctcaggtatgtctttatcagcagcatgaaaatggactaatacatatgtattaatacatatggactaatacatatgtattaatacatatggactaatacatatgtcagttaaatctcaataaagctcttatttaaaaattatagaccatgcagcaaaatggcagtatagacagcttcaagttctcatccctccacagaaatatcaaaaaacaagcagaaactgtcagaaccaactttgtcaaaactctggaaaacagtcaaaatgtttacaacaaccaagtaaatcaaggaaaaaagggaaaaaaggcagctgaaaatggtaagtaaattgtgtagtgtgtttacttgtccttgtcccatctcctccagggtgtagtggcagtcttaaagcagtggcatcccatgttcccagtgtgggaccctgatccctggttccaggaatagcatagcaggtattaatcacaaatcatagtgtaagtccattctagtctctctaggggcttcctgaaagactgacacaggcacttgtttttgtttattttaactcagaacttagaccatactaagcattcacttcaggctcagtgtaagcctggataagtgttggattgtctcagcacagagacaatctgcaaagactgggagaggtgtttggttttgatttgggggtttttcagcaggaggaagagtttgcttttctgttgttgttgttgtttattgtttgtttttgtttccagctcctggaattcaaggaaatctctatgaaaacaccagctgaacataagctttttaaaaaaaaacccagaaacttcagtgaccatacgtgacaagggatacaacctttgcaaaaatagattggaaaagttactaaacatacagactacaacagccttcaacaatcaacgaaacagcaaaccctgaagaaagaggagaatctgatttccacagttaccacactataatattcaaacgtacagttttcaacaaaaacaaatcacaaagcatacaaaaaaatgggaaagtagcaaaataaatggatagaagccatcctcaaggaagtccagacaatggacttgagacaaagactttaagaggccaggcacggtggctcacgcctgtaatcccagcactttgggaggccacggcgggtggatcacaatgtcaggagatcgagaccatcctggctaacatggtgaaaccccgtctctactaaaaatacaaaaaattagccgggcatggtggtggatgcctgtagtcccagctactggggaggctgaggcaggagaatggtgtgaacccgggaggcagagcttgcagtgagctgagattgcaccactgcactccagcccgggcgacagagtgagactaaatctcaaaaaaaaaaaaaaaaaaaaagctgtattaaatatgttcaaacagctaaaggaaaacttggacaaggtactaatgaaaatcaggacagatatatatttgaaatttttaatatcaataaagagataaaaattatttaaaagggaaaaagaaatacaaaaatcaaatagcaaaaaggtagaagtaagttcttccatatcagtaatcactttaaatgtaaattgattaaatcatccaatcaaaaggcagaaattggcaggatagttagaaaacatgatccaactatatgttgtctgtctacaacagtctcactttatattcaaagacacaaataggttgaacataaaaggatggagaaaaagcattccatgcaaatagtaaccaaaagatagctgggtggcaatatatgtatcaaacaaaacaaactgttacaagaaacaaagaatgaaattatatattgataaaagggtcaattcattaataatgtataattattataaacatatgtgcaacaaacagttaaaacctcaaaatatgaaataagctgacagaaatgaaggaagaaatacactgttctaaaataacagtggaagacacaataccctattctaaacaatggatagacagaagatgaataagaaagtagaggatttgaacagcaccataaaccagctagaccaacaaatatagaacactccattcaacaacagcagaatacatattcttctcaaaacacacattcttctgaagtgcaaatgaaacattctccagaatagaccatatgttaggtcataaaacaagtcccaataaattttttaaacattgaaaccatacaaagtatcttcctcgaccacatgcagtgaagtcaataactaaaggaaaactggaaattttgcaaatatgtggaagttaaatgacataagcaaccaatgagtcaaagaagaaattaaaaaggaggttagagtatacttagagatgaatgaagatgaaaacacagcataccaaaaatttgggaataaagtgaagacactgattagagggaaatttgtagttcgtcccttgcttccttccttccttcctttcttccttccttccttcctttcttccttccttctttttttctttctctttttctttctttcttttttcttctttcttttcttttctttctttcttctttctttttttttttgacagagtctccctctgtcgcccaggctggagtgcagtggtgcgatcttggctcactgcaacctctacctctcaggttcaagcaattcttgtgcctcagtctcctgagtagctgggactggaaatttatagttctaaatgcttacattaaaaaataaaaagagagagctcaagtcaacaacttcgctttacccactgaggaaaaaaaaaaaaaacccactaaacacaaaactagcagaagggaggaaataataaacattagagtggagataaacaaaatggagaatagaaaaacagtagaaagaatgaatgaaacccaaagttggttcatttttaaaaatcaacaaaattgacaaacttttgcacagaatgacaatagaagaaagagggaataagtaagtaaaataggccaggcacagtggctcatgtctgtaatcccagcactttgggaggccaaggcaggtggatcacctgaggtcgggagttcaagaccagcctgaccaacatggagaacccccatctctattaaaaatacaaaattagccgggtgtggtggtgcatgcctgtaatcccagctacttgggaggctgagacaggaaagtcacttgagcccgggaggcggaggttgcagtgagccgagattaagccattgcactccagcctgggcaacaataacagcaacaaaaaaagtaagtaaaataataaatgaaagtggagatattactaccagccttgcaaaaataaaaattattacaaaagaatactataaacaattgctcatgaataaattagattaagtggacaaattcctagaaacacaaaaattccctaaagcaactcaagaagaaatagaaaatcttaacctacctataacaagcagagattgcaatagcagtgaaaaacctcccaacaaaggaaaaaccagagccagatgatttcacttataaattccaaaattttttttttttttttgagacggagtttctctcttgtcgcccaggctggagtgcaatggcacgattttggctcactgcaacctccgcctcccgggttccagttattctcctgcctcagcctcccaagtagctgggattacaggtgcctgccaccatgccccaggtaatttttgtatttttagtagagacggggtttcaccatgtaggccaggctggtcttgaactcctgacctcgggtgatccgcccaccttggcctcccaaaatgctgggattacaggcatgagccactatgcctggccaaattctaccaaatatttaaagaagaattaaagccaattattttcaaactctttcaaaaaatagaagaagggggaatactttataactcattatttgaggccagaattaacctgatactaaagccagatgaagacatacaatgtaaaaaaaaaaaaaaaagaaaagaaagaaaaaaaagaaagaaagaaattacaggctaacatcccttatgaaactctttcaagaaatagaagggggaatactttctaactcattctttgaggacagaattaacctaataccaaagccagatgaaggcatacaatgttaaaaaaaaaatacagactaaactcccttatgaatttagaggcaaaggtcctcaactaaatactaacaaagcaaatctagtcacatattaaaaggattatacatcataatcatgtaggatttatcacatgaattgaaggaacattcaacctaagaaaagccaatcaatgtaatatattacattaataagaaggaagaggaaaaacccacatggtcttctcaattgagactggaaaagcatttcacaaaatctataccttttgatgataaaaacactcagaaaactaggaataaaaggaaactttctcaacatgaaaaagaacatttatggaaaaactcacagctaacatactcaattatgaaaaactgaaaacttttcccctttaagatcaagaacaagacaaagatgctgactgggagcagtggctcacacctataatcccagcactttgggaggccgaggctagacttgaggtcaggagttcaagatcagcctggccaacatagcaaaaccctgtctctactaaaaatacaaaaactagctgggtgtaggggtgtgcacctgtaatcccagccactcaggaagctgaggcaagagaatcacttgaacccaggaggcagaggtgtcagtgagcggaaatcatgccactgcactccagcatgggtgacagagtgaaactccgtctcagaaaaaaaaaaaaaaaaaaaaaacaaagatgcctagcttcatcactgctattcaaaattgtactagaagttctggctagagcaataagacaagaaaaagaaattaaaacatcagaattgaaaaagaagaaataaggcaaggtgaggtggctcatgcctgtaatcccagcagtttgggaggctgagaagggtggatcacttgaggctaggagttgaagaccaacctgattaacatggtgaaaccccacatctaccccaaaaaaaatacaaaaattagccaggtgtggtggcaggtgcctgtaatcccagctactcaggaggctgaggcaggagaattgtttgaacccaggaggcagaggttgcagtaagtcgagatggagccactgcactccaacctgggcaacagagtgagactccaactcaaaaaaaaaaaaaaaagaaaagaaaagaagaaataaaactacctctattcacagatgacatgatcccatatatttaaaaatcccaaataatccacaacaaaagctattagagctaataatcaaattcagccaaattgtggggtacaatgtcaacacacaaaatcacttgtatttctattcaacagaatccagaaaggtgattagtaaagaaattctgttaaaatggcatctaaaagaataaaatagctaaaaataaatttaaccaaggagttgaacaacttgtacactgaaactaggaaactttgatgaaataagtttaagaaaacctaaatatacaaaaagcattccatgttaattggtatgaaggcttaatatttttttaaaacacaatactatctcaaatggtctacagatttaatgcaatctgtagcaaattccaacaggtttttttcttacagaaatgggaaggctaatcctcaaaatttttttttaatcctaaaatttatgtgaaactacaaggggccctgaatagctaacacaatcttgaaaaagatgaagaaagttggaggacatttttctcaatctctaaaattactatgaaggtactaaaatcaaaacagtgcagtactggcataagtatagacatatagatgaatgaaataaaattgaaaggccagaaatgaatgcagccatctgtggctaatcgtttttgataaggatgttgaaaccattcactgggggaaagaatagcctttccaacatatggtgccaggacaattgaacttctatatgaaaagaataaagttggacccttatctgacaccatgtacaaaaatcaagtcaaaatgtatcaaccttgtttgcacacgttactaaaattttagaaagtatcaatctgggcagggcacggaggctcatgcctgtaatcccagtgctttgggaggccgaggtgggcggatcacaagatcaggagattgagaccatcctggctaacacggtgaaaccccatctctactaaaaatacaaaaaattagccaggcgtggtggcacacacctgtattcccagctactcaggaggataatggcttgaacctgggaggtggaggttgccgtgagccgagatcacaccactacactccagcctgggcgacagagggagactccacctcaaaaacaacaacaacagagaagtatcaaccaaaatataagacctaaaactgtaaaactctcaaaaaaaaaaaaaagtgaaaatcttcataatctagtatttgacaatggatccttggaaaggaaaccaaaagtaacaaaagaaaaaaaaataggtaaattggatttcatgaaaatttaagacttttatgtatcaaaaaacatcatggaggaggaggagccaagatggccgaataggagcagctccggtctacagctcccagagtaagcgacgcagaagacgggtgatttctgcatttccatctgaggtaccgggttcatctcactagggagtgccagacagtgggcgcaggtcagtgggtgtgcgcaccgtgcgcgacccgaagcaggacgaggcattgcctcacttgggaagcgcaaggggtcagggagttccctttctgagtcaaagaaaggggtgacggacggcacctggaaaatcgggtcactcccacccgaatactgcgcttttccgacgggcttggaaagcggcgcaccgcgagattgtatcccgcacctggctcggaggttcctgcgcccacggagtctcactggttgctagcacagcactctgagatggagctgcggggcggcagcgaggctgggggaggggcgccctccattgcccaggcttgcttaggtaaacaaagcagccgggaagctccaactgggtggagactaccacagatcaaggaggccagcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagattgcctcctcacgtgggtccctgacccctgatccccgagcagcctaactgggaggcaccccccagcaggggcacactgacacctcacacggccgggtactccaacagacctgcagctgagggtcctctctgttaaaaggaaaactaacaaacagaaaggacatccacaccaaaaacccatctgtacatcaccatcatcaaagaccaaaagtagataaaaccacaaagatggggaaaaaacggaacagaagaactggaaactctaaaaagcagagcacctctcctcctccaaaggaacgcagttcctcaccagcaacggaacaaagctggatggagaatgactttgacgagctgagagaagaaggcttcagacgatcaaattgctctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgagaagaatgcagaagcctcaggagccgatgcgatcaactggaagaaagggtatcagcgatggaagatgaaatgaatgaaatgaagcgagaagggaagtttagagaaaaaagaataaaaagaaatgaacaaagcctccaagaaatatgggactatgtgaaaagaccaaatctacgtctgattggtgtacctgaaagtgatgtggagaatggaatcaagttggaaaacactctgcaggatattatccaggagaacttccccaatctagcaaggcaggccaacgttcagattcaggaaatacagagaatgccacgaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccttacaagagctcctgaaggaagcactaaacatggaaaggaacaaccggtaccagccactgcaaaatcatgccaaaatataaagaccatcaagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccaacagtgtgctgtattcaggaaacccatctcacatgcagagacacacataggctcaaaataaaaggatggaggaagatctaccaagccaatggaaaaccaaaaaaggaaggggttgcaatcctagtctctgataaaacagactttaaaccaacaaagatcaaaagagacaaagaaggccattacataatggtaaagggatcaattcaacaagaagagctaactatcctaaatatatatgcacccaatacatgagcaccaagattcataaagcaagtcctgagtgacctacaaagagacttagactcccacacattaataatgggagactttaacaccccactgtcaacattagacagatcaacaagacagaaagtcagcaaggatacccaggaattgaactcagctctgcaccaagcggacctaatagacatctaaagaactctccaccccaaatcaacagcatatatatctttgtcagcatcacatggcacttattccaaaactgaccacttagttggaagtgaagaaatcctcagcaaatgtaaaagaacagaaattataacaaactatctctcagaccacagtgcaatcaaactagaactcaggattaagaatctcactcaataccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtctgtagagggaaatttatagcactaaatgtccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccaatcccacagaaatacaaactaccatcagggaatactacaaacacctctacgcaaataaactagaaaatctagaagaaatgcataaattcctggacacatacactctcccaagactaaaccaggaagaagttgaatctctgaatagaccaataacaggagctgaaattgtggcaataatcaatagcttaccaaccaaaaaaagtccaggaccagatggattcacaggcgaattctaccagaggtacaaggaggaactggtaccattccttctaaactattccaatcaatagaaaaagagggaatcctccctaactcattttatgaggccagcatcattctgataccaaagccaggcacagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggaggcaaggctggttcaatatatgcaaatcaataaatgtaatccagcatataaacagagccaaagacaaaaaccacatgattatctcaatagatgcggaaaaggcctttgacaaaattcaacaactcttcatgctaaaaactctcaataaattaggtattgatgggacgtatttcaaaataataagagctatctatgacaaacccacagccaatatcatactgaatgggaaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatgcaaacaaatggaagaacattccatgctcatgggtaggaagaatcaatatcgtgaaaatggccatactgcccaaggtaatttacagattcaatgccatccccatcaagctaccaatgactttcttcacagaattggaaaaaaccactttaaagttcatatggaaccaaaaaagagcccacatcaccaaagcaatcctaagccaaaagaacaaagctagaggcatcacactacctgacttcaaactatactacaaggctacagtaaccaaaacagcatggtactggtaccaaaacagagatatagatcaatggaacagaacacagccctcagaaataacgccgcatatctacaactatctgatctttgacaaacctgacaaaaacaagcaatggggaaagggttccctatttaataaatggtgctgggaaaactggctagccatatgtagaaagctgaaactggatcccttccttacaccttatacaaaaatcaattcaagatggattaaagacttaaacgttagacctaaaaccacaaaaaccctagaagaaaacttaggcattaccattcaggacataggcatgggcatggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaggacatttatgcagccaaaaaacacatgaaaaaatgctcaccatcactggccatcagagaaatgcaaatcaaaaccacaatgagataccatctcacacctgttagaatggcaatcattaaaaagtcaggaaacaacaggtgttggagaggatgtggagaaataggaacacttttacactgttggtgggactgtaaactagttcaaccgttgtggaagtcagtgtggcgattcctcagggatctagaactggaaataccatttgacccagccatcccattactgggtatatacccaaaggactataaatcatgctgctataaagacacatgcacacgtatgtttgttgtagcattattcacaatagcaaagacttggaaccaactcaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagtgcaccagcatggcacatgtatacatttgtaactaacctgcacaatgtgcacatgtaccctaaaacttaaagtataattaaaaaaaaaaaagaaaaaataaataaataaataaaagaaaaaaaaaaacagagagtcaaatcatgaatgaactctgattcacaattgctacaagagaataaaatacctaggaatacaacttacaagggatgtgaaggacctcttcaaggagaattacaaaccactgctcaaggaaataagaggacacaacaaagggaaaaacattccatgctcatggataggaagaaagaatatcatgaatatggccatactgtccaaagtaatttatagcttcaatgctatccccattaagctaccattgactttctccacaaaattagaaaaaaaactactttaaattttatatggaagaaaaaaagagcccgtataaccaagaaaatcctaagcaaaaagaacaaagctggaggcatcacacttgctgacttcaaactataataccaggctacagtaaccaaaacaacatggtactggtaccaaaacagatatatagaccaatggaacagaacagaggtctcagaaataaaactacatatctacaaccatctgatctttgacaaacctgacaaaaacaagcaatggggaaaggattccctatttaataaatggtgttgggaaaactggctagccatatgcagaaaactgaaactggacctcttccttacaccttatacaaagattaactcaagatgaataaggacctaaatgtaagacctaaaaccataaaaaccctagaagaaaacctaggcaataccattcaggacatagacataggcaaagacttcatgactaaaacaccaaaagcaattgcaacaaaagccaaaattgacaaatgggatctaattaaactaacgagcttctgcacagcaaaagaaactatcatcagagtgaacaggcaacctacagaatgggagaaaatttttgcaatctatccattcaacaaagggctaatatccagactatacaaagaacttaaacagatttataagaaaaatcaaacaaccccatcaaaaagtgagcagaggacatgaacagatacttctcaaaagaagacatttgtgctgtcaacaaacttatgaaaaaaagatcatcatcaccggtcattagagaaatgcaaatcaaaaccacaatgagataccttctcatactagttagaatggcaatcattaaaacgtcaggaaacagatgctgtagaggatgtggagaaatagaaatgcttttacactgttggtgggagtgaaaattagttcaaccattgtggaagacaatgtggcgattcctgaaggatctagaagcagaaataccatttgacccagcaatccattactgggtatattcccaaagtattataaatcattctgctataaagacacatgcacacatatgtttattgcagcactatttgcaagagcatagacttggaaccaacccaaatgcccatcaatgataaactggatgaagaaaacatggcacatatacacaatggaatactatgcatccataaaaaagaatgagttcatgtcctttgcaggggcatagatgaagctggaaaccatcattctcagcaaactaacacaggaacagaaaatcaaacacagcatgttctcactcataagtgggaattgaacaatgagaacacatggacacagggaacatcacacactgaggcctgttgggggttgggggcaaggggagggataacattaggagaaatacctaacgtagatggcgagttgatgggtgcagcaaaccaccatggcatatgtatatctacgtaacaaacctgcacattctgcccatgtatcccagaacttaaagtatatataaaaaaaagttgtatcgtacccccccccaaaaaaaaaaaacaccatggttcgggtgcagtggctcaaacctgtaatcctagcacttttggaggctgaggcgggggaatcacttgagaccagtctggctaacatggtgaaaccccatctctactaaaaatacagaaattagctgggtgtgggggcatgtgtctgtagtcctagctacttgagaagctgaggcaggaggatcgcttgaacccaggaggaggaggtggcagtgagctaagatcgcaacactgcactccagcttgggtgacagagcgagaccctgcttcacaaaaataaacaaaaaaaaaaaccattacgaagaaacagaaaagacaagctacaaaatgggagaaaatagttgcaaattatatatgataaggagttagtatccaaaatatatagagaattgctacagctcagcaacaaaaagatgaataacctgagtccattttgtgctgctataacagaatacccgagagtaggtaatttatgaggaacagaaaagtattggcttacacttgtggaggctacgaagtccaagattaaggagctagcatctagtgagggctatcttgatgtgtcatcacatagtggaaggctagagggcaagagagggtgagagagagagaaaaggggaccaaacttgccttttataatgagccttttcccacaataacaaacccactcctgtgttaatacacttcatgacctaatcacctctcattaggtcccacctcccacctcccaattgttgcattggggagtaagtttccaacacacttttggagggacacattcaaaccatagcacaacccaatttaaaaaatggacaaagtacttgcatagatatttcttcaaagaagatataaaatatcaaataagcacataaaaatatgctcaacatttttagtcattaggaaaatgcaaaacaaacccacaatgagctaccacttcacaaccattaggatggctataacccaaaaagagtggagtattggtgaggatatagagaaattggagcttctgtgaactgttggtgggaatattaaatggtacaggcactttggaaaacagtatgacaatacctcaaaaaattaaaaaccaaattaccatgtgatctggaaatttcaatcctgggtatatactcaaagtaattgaaagcagggtctcaaagagatactcatacacccaagttcacagcagcattgttcaaaatagctgaaaggtagaagcaacccaagtgtccatcaaaggatgaatgaaatatactaaatgttgtatagacatacaatggaatattattcagccttacaagggaaggaaattttgacacaagctacaacatggatgaagcttgaggacattatgctaagtgaaataaaccagtcacagaaatactgatactggccaggcacagtggctcacacctgtaatccccgcactttgggaggccgaggtgggtggatcacctgaggtcaaaagtttgagatcagcctgggcaacatggtgaaattccgtctctactaaaaatacaaaaattagctgggcatggtggcacacacctgtaatcgcagctacttgggaggctgaggcaggagaatcgcttgaacctgggaggcggaggttgcagtgagccaagattgtgccactgcacgccagcctggatgagacagcaagactccaaaaaaaaaaaaaaatagaaagaaagaaagaaagaaaggaaggatggaagaaactgtataatttaacttgtatgaggtacctgaagtagtcaaattcattgagacagaaagaaaaattatggtttccctaggcctggtggaagggcaaaatgaggagttgttgtttaatgggtatagaatttcaattttgcaagatgaaaagagttctggagattggttatataacaatgtgaatatgcttaacactacagaattgtaaatctacaaattgttaaaatggtaaattttatgttatgtgtatttgtttttgaggagtctcactctgtcacccacactggagtgcagtggcatgttaagtgtattttgctacagttaaaaataaacaagtattaaaagctttaaaaaagaatagaaagtaaatgttgaaaagttgtggggaaattctaagtttcatacattgttagtaataatgcaaaatggtgcagatgctatgggaagcagtttggcagttcctcaaaaagttaaacatagaattaccatatgacccagcaattccactccttggtatacacccaaaagaatttaaaacaggtattcaaacagatacctgtatgccaatgttcactgcagcattattcacaatagccaaaatatggaaacaactcatatgtccatcaacagatcaatggataaataaaatacggtatatacatacaatggaatattattcatttgttaaaaggaatgaagttcttatatatgctgtaatgtgaatgagccttgaaaacattgttaatgaaataagccaaaaacaaaaggacaaatattatataaagacacttatatgaaatattcaaaatgggcaaattcatacagacagaaagtagattagaagttaccagggacaggagggaggcagggagtaggaagttattgcttaatggttacagagtttccgtttgggttgatgaaaacgtttcagaaatagataagtggtgatggttgcacaacactgtgaatgtaattaaagccactgaattgaacacttgaaaatggttaagttggaaaattttgtgatatgtattttgccacagttaaaaaaataccaaaaaggaaaaaatggtaataacgggtacaataaatataattcttatggctataatctattgtaaccatttatgaagtacctactccatgctaggtctaggtaccgggaaaatagtagtgaagaatattctagtgagaggagacagacaacatacacacaaataagttgtcaggaaatctacttttttttttttaggtggagtcttgctctgtcacccaggctggaatgcagtggtgtgatctcagctcattgcaacctctgcctcccgggttcgagtgattctcctgcctcaacctcccaggtagctgggactacaggcacatgccaccacgcccggctaattttttgtatttttagtagagatggggtttcaccgtgttagccaggatggtcttgatctcctgacctcattatccgcccaccttggcctcccaaagtgctgggattacagacatgagccaccgcgcctggccaggaaatctactctttatccttaatactgttatggccctgggactatgtggcttctgttctccatgaccacttgctgagccctggcttgggtcaagccctagagactaggttgtagagctacgtgctttatatgtgatcaagttcatagcaatgggcatttcctgtacaagcagtctctgcccctccctttcctctgctctttaagaggtcaattttgccttgttctgggcaggcctgagccttaaactcaagagctgccttggaataacggagcccagggtaggcatggaaaccctatatccccttgcattctggacacttcactggcttttacttctccttgactcagttccttgggtgcatagagtgttcttggcctcttcccctggtttttgcccaggcctgtctgattggctttccaacaatctcttcccttccctactccccaccaacaccttcagggactttgtatatatagctccagggctctcattgagagccctggagctataaatataataaaaaataaaatataaatgaataaaaaataatgagctaatacaagccccagttaagttaccaattggctttttggtgttaagcaggcaaaaccaaaccaagaagtcatttattcttcagtttggtagacatttaatgagctctgtctcaggtgttggcaatttcacttcacaaccagaatcatggtagtaaccatttcttgagcacctattgtgagcaggacaattctcattgattaactcactgaatttttatacaaccctgtatgtgggtggggcttatcctttttcagcagagaagctgaggttcagagagacatggctgaggttactgagaatgcctggtacacttagaccattccaaagctcttgtttactccacacagacagcatgccatgtactctgccaacacctcacctcaatgttccccataaccctcagcacacactgcatgcttagccccattttccccttacatgtctcacatataaaatctccccgatacacactgcctgcctatatcctgtgtttcttgcattccacacaaaaactgaaatgcacatccagactgactttacaaggacactgacacccacaactttccctcccctgacacttcgcatacacacacacacacacacacctcacatacacatattcctgcatgggccttgcataaataagccctaccttccacctacccactcaggtatgaacacatctcctagaaatacacagtcacaactgtgttctagcaacaaaactgggtacagaggttcttcactcaccctgcctcatgctcctccctttctcctcctctcccaggcctgccctgtctccatgcaaaactgtcttcatttaactcacacacagtctcataccgactgacaggctctgcccagcccatatccaaagattgtaaatccttcccaccccctttccttgtttgtctgccccacaccgtggcatttggaatcagttcgcagagatgactacacagacagagctttgtcctgcacctcagggaagggcagtctggtagggctatgcccctttccacctgcccttgcaccctgcctccctttcagtgttgaatacatttccttgtatctttttatttcttaattttaattgagacagagtcttgggctcacttgggcagatcacttgggctcaagtgatcctcctgcctcaacctcctgagtagcaacaattacaagcatgtgtcaccacgcccagtgacttttccttatatttgcctttatggtgggagaggttgagccccagaaccatgtcccctgcctcctgtctttcaaacatttggctcaggatagggcagaattggaagtgagggcagggaatggtctggaatagcaaagacctcctgggttcacataaaggcatggagacaggaccttacccaagaacccaggcttaagattgacaattgggtacttgttctgtagccaccaccactggtctccttcctgaagttaactctcagtgccttattctatgatatcatgaatacaaggatgccagggtctttcttcactgctaaatgtgcctttgggtgactccttccctgaccctgtgtctctattttccccatctgtcaaaggaaacccagttatgaggtctactctatcaccacaaggaatggagagtacatcggggttatatcaggcttggtgtaggctgggagttttctccatagcttcattttctcaagatc

SEQ ID NO: 54 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 55 - DNA, 808 bp, Homo sapiens
  misc_feature (13)..(13): n = a, c, g or t
  misc_feature (36)..(36): n = a, c, g or t
  misc_feature (44)..(44): n = a, c, g or t
  misc_feature (298)..(298): n = a, c, g or t
  misc_feature (302)..(302): n = a, c, g or t
  misc_feature (310)..(310): n = a, c, g or t
  misc_feature (330)..(330): n = a, c, g or t
  misc_feature (334)..(334): n = a, c, g or t
  misc_feature (361)..(361): n = a, c, g or t
  misc_feature (415)..(415): n = a, c, g or t
  misc_feature (417)..(417): n = a, c, g or t
  misc_feature (422)..(422): n = a, c, g or t
  misc_feature (426)..(426): n = a, c, g or t
  misc_feature (430)..(431): n = a, c, g or t
  misc_feature (433)..(433): n = a, c, g or t
  misc_feature (438)..(439): n = a, c, g or t
  misc_feature (449)..(449): n = a, c, g or t
  misc_feature (455)..(455): n = a, c, g or t
  misc_feature (474)..(474): n = a, c, g or t
  misc_feature (476)..(476): n = a, c, g or t
  misc_feature (478)..(478): n = a, c, g or t
  misc_feature (501)..(501): n = a, c, g or t
  misc_feature (534)..(534): n = a, c, g or t
  misc_feature (539)..(539): n = a, c, g or t
  misc_feature (543)..(543): n = a, c, g or t
  misc_feature (555)..(555): n = a, c, g or t
  misc_feature (557)..(557): n = a, c, g or t
  misc_feature (560)..(560): n = a, c, g or t
  misc_feature (565)..(566): n = a, c, g or t
  misc_feature (568)..(568): n = a, c, g or t
  misc_feature (582)..(582): n = a, c, g or t
  misc_feature (588)..(588): n = a, c, g or t
  misc_feature (595)..(595): n = a, c, g or t
  misc_feature (605)..(605): n = a, c, g or t
  misc_feature (609)..(609): n = a, c, g or t
  misc_feature (620)..(620): n = a, c, g or t
  misc_feature (627)..(628): n = a, c, g or t
  misc_feature (635)..(635): n = a, c, g or t
  misc_feature (639)..(640): n = a, c, g or t
  misc_feature (647)..(647): n = a, c, g or t
  misc_feature (655)..(655): n = a, c, g or t
  misc_feature (664)..(664): n = a, c, g or t
  misc_feature (667)..(669): n = a, c, g or t
  misc_feature (677)..(677): n = a, c, g or t
  misc_feature (692)..(692): n = a, c, g or t
  misc_feature (694)..(694): n = a, c, g or t
  misc_feature (696)..(697): n = a, c, g or t
  misc_feature (701)..(701): n = a, c, g or t
  misc_feature (705)..(705): n = a, c, g or t
  misc_feature (713)..(714): n = a, c, g or t
  misc_feature (718)..(719): n = a, c, g or t
  misc_feature (723)..(724): n = a, c, g or t
  misc_feature (728)..(728): n = a, c, g or t
  misc_feature (735)..(735): n = a, c, g or t
  misc_feature (749)..(749): n = a, c, g or t
  misc_feature (751)..(751): n = a, c, g or t
  misc_feature (753)..(753): n = a, c, g or t
  misc_feature (760)..(760): n = a, c, g or t
  misc_feature (766)..(766): n = a, c, g or t
  misc_feature (769)..(769): n = a, c, g or t
  misc_feature (773)..(774): n = a, c, g or t
  misc_feature (780)..(780): n = a, c, g or t
  misc_feature (788)..(788): n = a, c, g or t
  misc_feature (791)..(791): n = a, c, g or t
  misc_feature (793)..(793): n = a, c, g or t
  misc_feature (795)..(795): n = a, c, g or t
  misc_feature (805)..(805): n = a, c, g or t
  misc_feature (808)..(808): n = a, c, g or t
gcacgaggtttgncgtggttataaaacaattagcangaatcccntgtacaaaacacatgaaaccaaacacttcatctacttctaccgtgggccaagtggcattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaancaanttagcagnattagcctacatttgtaatntatntttctatttccatacttctgcccacgntgttttctctcaaaatccattcctttaaaaattaaatctggatgcaggattgananataanaatnaatnntntcctnngtgggggggnggcccnggtccccaaatttcggccntntnagtggtgtcggtcttacaagttnctcttggccggtcggtttttaaatcggcggtgnccttngggnaaacccttgggngnttnccctnncnttacttcggctttngggggnctatccnccctttttgnctcncttgggggaanttggggnngtgggcntganncggtttngccttttnccattcagnttnnnggcggttnaatttgggggattgncnanntgtnaggnggtaagtnntttnnttanntttngggggtnaatgtttttgtgtnantnggggttntgtttntancccnntggggnggttttgnggntntncctttttttnttn

SEQ ID NO: 56 - protein, 89 aa, Homo sapiens
MCDRKAVIKNADMSEEMQQDSVECATQALEKYNIEKDIAAHIKKEFDKKYNPTWHCIVGRNFGSYVTHETKHFIYFYLGQVAILLFKSG

SEQ ID NO: 57 - DNA, 478 bp, Homo sapiens
tgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactgggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcggacaaaccgcgtactgtgaacctt

SEQ ID NO: 58 - protein, 589 aa, Homo sapiens
VATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 59 - DNA, 2372 bp, Homo sapiens
ttctgggatggctatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttgctttaacatctttttttttttttgacagagtctcaatctgttacccaggctggagtgcagtggtgctatcttggctcactgcaaacccgcctcccaggtttaagcgattctcatgcctcagcctcccagtagctgggattagaggcatgtgcatcatacccagctaatttttgtattttttattttttatttttagtagagacagggtttcgcaatgttggccaggcgatctcgaacttctggcctctagcgatctgccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattctatttgtctataatgatcatatattacctttgtaataaaacattataatc

SEQ ID NO: 60 - protein, 317 aa, Homo sapiens [sequence omitted]

SEQ ID NO: 61 - DNA, 139389 bp, Homo sapiens
gatcacaagggtagggctctaatcctactagagggctagtgtcctattgtaagaagagaaagagaaacaataaggccaggtaagcacacagcgcaaaggcagctgccgcaagccagcaagagagtcctcccaaggctccaaccccttaatttaataaaccatcaaagacagaaaccccaaaccccactgggcccaactggctcttctgagtccacctgcacttccatccctgagcctgtgcttctgctttgcagctgatttgttttttctttgactcaaattttttctctcagtggagtcaaaaacctggacaaggctaaggtctggtctctcctggattcggagaacttcctaaacccaccagcaccaatgtgaccaggaattttccaaaaaggtaaatcaaaacaggcagttttgtaactgcaaccaatcaaataatgtccttattgcagtttcatatttactcgataaatacttgtctctgacactttttcatcataacatgaagcctcttccagtttggttttctcaattcatgaattccttcttattcaaataaatgttactgtgcctcagatttttctttgacaaggggtatctgagatcatgggaatgaggccctgcctgaggcagtcatccctggtcagcaggtgcttgtgatgggcagtgcagggcgggtgccctaacacagatgaggggactgggtggcttccacctggaatcaacaggggatagatagaggagatagaggggatgcaaactaattcttagggaggccctactgtgtggcaggctttggccaggccaggtacccttataatatttaatcttcgtgacaacatggggaaatattattttcatggtacacgagaggggaggtaaggagctccaggtcacacagaagggacttggaaaaggccagaccggggtccatttaagttggaagctgggtcaagcatgatacattcccatagggccactcagaacagaggggctggtgcagggcaagagctggagggaggggaccggcctgtgctggaaaaaaccctgggtcagcagggagaagagcggtagataagagatcagggctgcaggtcaacctcctctcccacccctcccctcctcctggaccctgctcttcccccactcccctctcttgcttgttccacttcctcatggctgtcctgccccacttgagtcatctgctgggtgacagggtagggaggaagtgggcacctgggccgtgtcaccccgaggagaggtcaggatgcagatgacccccagacccctgggtcgggggactccacgtgacctcttctgctgctcggggcagactcattggcctcctagtccatctgggttcttctggggctcactcagctgtggaggtgccaccctccattctaggtgcgagtaggaactagccaggaaagaggaagcgagcctacctgggttcatggtgccagcggctgggttaccgaggggctttccttggagctctccagtcactgtccagactggaaggttttccttaacccttgagaacgagaaaacaaattgtgggatcgaaggtgagcctcctgtgtacagagggaggctggaggggctgggtctttgcagatccctctgtggtagcagcaaatgtccagagtgtttatctcctggggccctgccagctagtatttacagaaactcacctcgttccagcttcctcttccctcactctcacaccaaggcagggtcctcttgtcctgtaggggtatgagaagaagataatcagaggaggggcagccatctgatcattacagaaactacagagtctatacacaggaatagagatgggagggaacattctgacaatgacctgggcctgggaacatgtatgataactagttgatgatagccagtgtgtattgtgtgtctgtgatgtgcatggcctctgacatgtatctcattcgatgatcacacacaggacaggagatgggtaccactttcccatttgaacacagaggaatccacaaaagttagggaacttatgggtgttttcacaatagtgctagagccaggacttctgcttcaatcccatgtcttcaattactgtgctctactcccttaaatatacaatattgagtcatgtatacacgctcatggtaaatgactcctcattgcaaatccctgtctcacactctgtgctcaactcttcgtcttggtgaactcactggtgctgcagtggacagcctgtgtccccgttgcttctctaagattctttgtcccacaaagacctggatcctgctagatgccggcccagcccctgctgtggctgccgagccctcctgatgcttccccgtcccctctgctgtcctcccctagctgatggaccttagggtgtttctaattcttcatataaattatgctacaaagaatatcctccctcacgtaaaactgctcacatttgagattatttccttaagatacttttaagagtagaatgactaggtcaaaagctattaacatctcaaaagtttttatacctagagccactctgtatgaaaactgtacaaattcacactcaaactaacaggatatgaagatgtccattctttcagtcttactggctctcagtagtcttttcttcaggaaaacaaaacaaaacaaaacattattccttgagacaaggtctcactcctagtatgcagcccaggctgctggcaaaatcctggccttaggggatcctcccaccctgccctctaaagtgctggattacaaacatgagccacgacacccggcctgaataaatgctgatctttatatagaggaaagttcttcacattctgctcctgattatcttaccctgggaggtgagggaaaatagcaaatgttaatcatattaatcatctttaggcactgttttaagaagacagaagagcatttatcaacctcccctcctgagatcaaactacagccatagtcaaggcacttacaggtataatggcacttaatgttaatgtgggcaaacattggtggattttgcaccactaattgctctaagatgttataaatagtaactcacagaactcttccaagaacctaggaagtgtgtaccattggtatttccattttcaggtaagaaaactgaaacagatgttcagtgacttgcccaagctcagaatctactacgtggtaaagactgggttcccacccagacagacggactcaagaactcacgcactgcctctgcaccctctgctgccaatgaaaatttaaatgagggcaacaggagatcagagatgccaagagatgttggaaaacagaactggctgaagaaatgacaactgaataaagaggggtgaagggagctgtgaaccacagcaatgccaagagggcatccagccaggcagagtggtctactaggcagagcctcagagaggggaggagttcaccaggcccacgtgccatatgggattcatgccagccttgagtctacaccagtgaaaaaaatcagagagttcatgactgaagcaatatgccccagaaataatatctttgtattctgacacttcagtgggttcccattcaatcaccctacagggaagactgccagtagacctgccccccaccccgttcaatatgaatagatctaggatcagaaattggagaaaggtgaaagtggggaaacagaccaagatgaccaaatacaaaaggagtccagaacaaacaagtaattttttaaatctcaaacccatgtcctcagggagattaaaaaatattttattcataaacttaaaacaagatatatagaaaagaagaaaaatcaatgaaacaaacaaaaaaagagattttctagaaactaaaaggtgatgatcaaataaacaagtctagagagaccatgtgaaagaaagtcacggaaatcctccagaaaataaaccaaaaagatgacagaggaaaaggagctatatggggaatagaaaagttaccaggcacagggtcacagggtgttctaagaaagctacttgagaatgagccaccgggaggaagaaagggtgggtgggtgggtgtgtgtgtgtgtgtgtgtgtgtgtgtgtgtatgtgttgtgcatccatggagggcaggtggggataaccaagaaagaaaaagacatgggatccagaaaacaggaaaatcaacccagagagaagggaatctgaggatcacagtgggacatgcagtaggcctacaaaacgaccagtccaggatggaataaaaagggaatggttctgtgggaaaaagggactcaatagaatacctcaaaggattcacagtttgagagaaactgaggaaatgaagaaggcaagcagtacaagggaggaaaaaaaacaaaggcaattagaaacatcaggaaaaagtaaagctgtgccacaaaacatgtgcaaacatggtgtacaactcagctccacagtaaatagtatttaaaacatcacaaaatgtaaacactcttgattgatttttaactttgagaacagaacagagcatataaatatgagaactaaatatacttgttaccgattagtacaaacttaaagcacaaaggtagcagttgggatgtgaagcactgaacgaaggagaaggaggattaatattgtcatcttttaaagaggggagtcaagaaatactaggtaaaactgagagtataagaaagaaagttgtaagtaaattgtttacagctacaaagttgctaatggaggacataaaactggtgatacaatattaggaaaaggtggagaggagagatagagggagtgtacaaacaagatgaaaatgactaataatgacactataagtaataatgataataccgattcaggcccatcccagttaggggcggctccaaaatcaccattgttcttttctcaccttgtgtctctgcgcactccccggcacacccacttccagcagctggtctttgtttgcagactttattttaacagctcagtggttcccgggcatcctccagctcttatacaaaagccccctcctcaaaagccactcgcctccctctttccacttcccacctctgtttcagggtcgaggcatccagatatctgtcttctggggcccctacgcagcaagactaaaagggggacccagtcctgggcagcagttcaccaggggagtatgcagaggggcatctggacacttcttgctgtaagggacggggtgacgggagggggtcttcccttccccttcttcctgctttgttcactctgtgacaccctaggccaggggagctgtctcaacgccatctcatgagccatgagaaccaggaggaccaggagggagaagaggagcaggagggcagacagagctggggcctcggacctgcccaatacttgtgaggagctgcatccaggatcccatcctcctgggtcattgttggcctggctcccacctttgtctggagcctctgctgggggttgaggctggatactgcccctcaggcttgactaggacacagtgtgtactccatgggtgagcctgcaggctggtcaattccggtgtccaactgagcgacctggaagaggagccctccctcccacctcagctctgagccaagctctccagatgcagaggacagggactctcagcaaagcatctccctccaagtggttgtggggcatcctccttgggcagggaaagaggagtcgaaatgatttcctgagaaatcgtcattttcattttatttttgagaaactgtcttgctctgtcacccagtctggagtgctttggggctatcacagcttgctgtagcctagagcccctgggctcaagtgatccttctgcctcagccttccaggtagctgggactacaggcacacggcaccatgcaggactaatttgttaatttttcatttcagagagacagcatctcctgtgttgcccaagctgtcttgagctcctagcatcatgtgattctcccgcctctgcctcccacagcactgaattacaggcctcagccgtggcactgcacccttctgaggaatcttcagtgaaaagccacggtcaagttcaaaccccatagcagggcacacaggccctctgatgctctggaccccaccttcctcaccgctccctgccaccacagtcaccttaggtccaggcacccactgacgccctgcttcggtgcctcctggagcccatctactcctcccactcccatccccagcctcaggccttcactcagctgctccctcgccctggaatgtcccccccactgtccccaccatgtgcaagtcacctgtcctcagagacccacccaaagctgcctggtccatgcggcggcccccaaccctccccaggctccctgagcactctgctttccagagggagctctacctgtatgtggctctttgggcctctgtctcccctttagactctgaacattcaatggggacactgttgtgttcccagctgcaccccctacgactgacctggatgccctccgccctccctggcacagcctggctgaaatcccaggtgcaggaggcattacttgaactaaaagcaaccagcctctggatgacatggcccagcttcagtttcactttcagttgagaaattgaatttaatttttctttctatcttgatgggcatctctttttggtgaagaacaaataagaccatgactcatatttcacagaaattacccccctgatttcatggacttttggcagctctatcaagttttttagaggggaaaaatcttaggctgggaggggaggtgacttgcccagagtcacacagctcttggagggcagaggggaggccaacatctgcccttgtgactctgatattgaagcaaaaatgggtgattttaataatccaacagtgtccaggtttgattctgcttctacaaacacagagacctaagctctcactcctgtagttatactcacaattccacagtgtggcttttgaatctcatgattgcaaagctggcatcatgccacaggtaccattctgcaatgcgaccttctcactcccctgtctcagccatgtttcccattagggacacagcacagcctgtttcttctctatcagctcagaggtctgaacagagggacagaggtgagggccagagacgtgaagtcctatgatctgcctgctcagcctcctgacacgggaccctggcaagtcattcccctcccagggcctcagtttccccacagggcctggcacaagtaggtgctcagactcagggtgagtgagacaacctctgagttccttgtgtctcaaaagaaatctgttgttcccattgggcttcagcagcagcaccctggggccagcctgggtgtggcccggccacaaggacatgccgggctccaggtcacctcccctcctccaccttctttgattccttcaaatttcccaaagagatgggcacccccaacacctacctttcttctggggtcagctggccgtgtctgagggtgtcagaaccagagctgagcccggggagctttgtgaacccatctaagctgttttccccacctctctctacagtttacccgcccagcaggagggagggagcaatcagactcaagcctgggtgcaaatcccggctctgccactgctttcctgtctgatctgaaccagctacctaacctctctgagcttatctacaaaagctgaatgatccttcccttatagagctattgcaagaataaggacatgggggtagatcacactatccccaacttaccaagggatcttcctctgacagagactgagcaagatccaactgttctgagctgtgtggatcccacgtccagctgtgcatctgtgtaataaccagacacgtcctccggcctcccagatataccctggaattcgaaagggaaagtgaaagtcacaacttcccagcagctcatgaccaagcacagtaaacacgctgctccccagcaccacctgcagtccaggcccagcctccttgctgctgcacttagaggagcagccgcagaccagacatccgggtccctctcatccaacccacctgcctcacatcctcaggattcaaggtctgctgtgtcagctgcccatgtctcaggcagtcagaaccagagttgagcctggggagttttttgaacccatctgagccgcttgccccccaacccccgccccgatctctgcagtttaagggcacagcaggtgggggagagaagtcagactcaagcctcagtgcaattccaggctctgcccctgttttactgtctgatctgaactagttacctaacctttctgagctcaagaaagacctgccactgactgaccgtggggctctccagattactccccgtccttccgttcccccacattcctcagatgcctgccttactcccacacatgccatcagcatcagcacagtcccccacacatgctgggtggatgcttattgcatatttattgtaatgcttctgaggttatgttttctgttatgtttttgatatagagtcttgctctgtagcccaggctggagagcagtggcacaatcatagctacttcaagtggcacaatcaagccatcctcccatctcagcttccgagtagctgggattacaggtgcctgccactacacccagctaattttttgtaattttagtagagatggggtttcaccatcttggccaggctggtcttgaactcctgacctcaagtgatccacctgccttggcctcccaaagtgctgggattacaggtgtgagccacggcgcccagcccattgtatccttcttgtgactttgtgtcttcatagcttagctcctactaataaatgagaacatacaatatttggttttccattcctgagttacttcactcagaataatggtgtccaacttcatccagattgttacggatgccattattcccttcctttttacagctgagtaatattccatggcatatacatatataggggtgtgtgtgtgtgtgtgtgtgtgtgtatatacacacacattttcttcatccacttgttggctgatgagcatttaggttggttccatattttttcggttgcaaattatgcagctataaacatgcatgtgcgagtatcttttttatataataacttttctcctctgggtagatacccggtagtgggattactggatcaaatggtattctacttttagttttttaaggagttgccatactgttttccatagtggttgtactagtttacattcccaccaccagtgtaaaagttttcccttgtcaccatattcacaccattttagctaggctggtcttgaactcctgacctcaagtgatccacctgctttggcctcccaaagtgctgggattacaggtgtgagccactgcacccttctattcttctttgatttttaaattatggccattcttgcaggagtaaggtggcaacttattgcagttttaatttgcatttctctgataattagtgacgttgagcacattttcatatttttttggccatttcattttgtatatcttcttttgagaattgtctattcatgtcctttgcccactttttgatgggattattttttttttcttgctgatttgtttgagttccttgtagaaactggatattagtcctttgtcaaatgcacagtttgcaaatattttctcccactttgagggttgtctgttttctctgctgattatttattttgctgtgcagaagctttttactttaattaggtcccatctctttatttttgttttcgttgcatttatttttgggttcttggtcctgaattctttgcctaagccaatgtctggaggagtttttccgatgttatcttctagaatttttatggtttcaggttttagatttaagtctttgatccatcttgagttgatttttgtatgaggatactgtttcattcttctacatgtggcttgccaattatcctggcaccatttgttgaatagggtgtcctttccgcactatacgtttttctttgctttgtcaaagactagttagctgaaagtatttggctttatttctgggttctctattctgttcccttgatctatgtgcctatttttataccggtaccattctgccattatgtaccttttttttttttttttttttttttttttgagatggagtctctctctgtcacccaagctggagtgcagtggtgcgatcttggctcgctgcaagctccacctcctgggttcatgctattctcctgcctcagcctcccgagtagctgggactacaggcgcccaccaccacacctggctaatttttttttttttttttttttgtattttagtagagatggggtttcactgtgttagccaggatggtctcgatctcctgacctcgtgatctgcctgccttagcctcccaaggtgctgggattacagatgtgagccactgcacccagcccttgtaccttttaagtgaaccatttagcccattttcattcaatgttagtattgagatataaagtgctgttctattcatcaggcaagttgttgcctaaataccttatttttttcattgtgttattgttttataggccctaaggcttataaaacaatatgctgtaaggaggttctattttggtgtatttcgaggttttgtttcaagacttagaactccgtttagcatttcttgtagtactggcttggtagtggcgaattctttcagcatttgtttgtctgaaaaagactttatctctccttcatttatgaagcttggttttgctggatacaaaattcttgactaacaattattttgtttaaggaggctaacaacaggactccagtcccttctggcttgtatggtttctgctgataaattagctgttaatctcatagattttcctttacaggttaccttatgcttttgtctcacagctcttaagattatttccttcttcttgactttagataccctgatgacatgtgcctaggtgaggatcattttgtgatgaatttcccagatgttctttgaacttcttgtatctggatatctagatctctagcaaggccaaggaagttttcctcaattattccctcaaataagttttccaaacttttagatttctcttcatcctcagcaacaccaattattcttaaatttggccatttaacataatctcaaatttcttggaggctttgctcattttttaaaattcttttttctttgtctttgtctgattgggttaatttgaaagctgtgtcttcaagctctgaagttctttcttctacttgttctagtctattgttgaaactttccagtgccttttgtatttctttcagtgtgtctttcatttccagaagctgtgattgttttttctttgtgatatctatttctctggagaattttcatccatattctgtattttttaaaatttctttaagttggttttcaccttcctctgctatctccttgaatagcttaataatcaaccttctaaattctttatatggcaattcagagattttttgttggcttgtatctattgctggggagctagcaatagctttggggggtgttatagaaatatgttttgtcatattaccagaattacttttccggttccttctcatttgggtagactatttcagtggaaagatctgaaactcaactccttctgttcaggttcttttgtcccacgggttattccttgatgtggtactctccttctcctaggaatagggcttcctgagagccagactgcagtgattgttattgctcttctgggtatagccacccactggggctataccagcctttgggttggtgctggggaatgtctgcaaagagtcctgtgatgtgatcatcttctggtctcctagccatggataccagcacctactctggtgtaggtgacaggcgagtgaagtagactccgtgagagtcattggttgtagttctctttagtgtgctgttttctccaatgctggttatgctagcagtgaagctgtcatgtggagagactgaggacctctggtcagtcaggatgttgcgggcagtggtattagctcttgtcttctccttcctgggaatagggttattctgtcatgagttgctgtaatggcctgagttggttggtctccagccaggaagtggcactttcaagagagcaccagctgcggtagtagaagggagatacaagcttgccctaggttgaccagggtaagtattctagtttctcaggtgattggcagggccataaagctcccacgagtttatgtcttttgtgttcagctaccaggataagtagagaaataccatcaggtggagggcagggttagctgggtctgagctcagactttccttaagcagggcttgctgcggccactgtgagggatgcagattgtcctaaggccaatggggtttgttacagaggggattatggctgcctctgctgtgccatatagttcgccagggaagtgggggatagctggcagcgagaggcctcacccagatcacatgcagttggcaaggctggccttgctcccgcagtgccccactaacaatgccaagtttagattcaggcagcctgtgcgcagaactcagaccttgtcccaggccataagcttctccactgagaaagcaagcatggctttcaggccttgcctctccccatctgcccacagtgtcagtggtggctcctgggctcatatttgcagaagttcctgttctccccctggattctgctcaagaaaattcaagcccagtagaaattattagaaaatccatctggaagcttctttcaccctgtgacccctcccaaattctgctggctgctttccccaaaggcctctgtgagataccgccagggatggtgccctgggcttgagctggacactgggaatgcctacaggattcttcccacttctgcttctacttttacattttgcatggttctctgaatccatttcagctatgggtaaggttaaatccctctcctgtaatctggattttcagattccccaggggcgatgtgtgtttggaggcagattttccctccctcacactttgggaactcccagttttttgcctgtctcatagaattggcaaggagcatgccacttctttcaaaggatctgtgaattctttcagttttcctggtacattcctgtggtggttcttggcacacattattacatgatgtgggtctccacatgctgtccggtccttccaagtgggagctgcatgttagccctgtctcctatctgccatcttcctcagacttctaacattaacttttaaaaagcttggtgggaagagaccagggccaaagttctccttcttggagatgaaagccaagaagcacttcctttgggacaagtcagaaaaatcctgaccaaatcaatgtgtgttcctggcgattctggcccaggcctatttcctccccatctgaggaattgcacaaacacagcagaacccttctgctggcccaggacatggagaggctggagtgaagttgatcagagctgggatggatcctggcttctgtccctgcacagctgtgggcctctaggattatgccttggagactggcatctggcgtctggcatctgtccaatgggaatagtaattcaatcatataggaggatggtgaaggccttagagtgaactccaggtcaaaggtgggggaccaagtaccatgatcctgccgaaaagtccagatagacctggaccaggggcagaaccaggggtcaggatgggcataagtgggcctaattggaaggtaagtaggaaggctgggacaccagggccaggactagggtgagaggagggaggcaccaaggacaccaaacgtaaggaggtcattgacttgcagaggacacatgagtgggagagggatatttcttccctccctgatttgatcccatcagtgattggcatagtgggccgtgagtgacggtttcccccacaccaagcctgagaactgtgagaactgtggagtttttgcgtgccctttgggaccctcttgtgttctacatagagtagcccctgaccctgggaaagcagtgtggcttagtgaccacttccggagtcagaatgggtggctgccaatttttgtaatttcaggggttctgaggaaacccataagttgccaaccaaagaggaaaacacttcgtctaccatcttgtccaaattcaggtcttttcagcattagcaatttatatagatggttctgaaagtgtcttgagtcttctagaggctccataaaattgcacatggccttggcaagcacagaggtgaagccatcactccttaggcatcgattaggctggtgacatctgaaagtgagacctggaaggttggaggtgcaggtggtaggtcaggaggcagtaaggtggctggagaatccatgtggactctccaaaactaatagccaggtctcctcctccagtcaactggtgcggtgcttggaaccagtgaccatcagtcagaaggtcaaagggcatgaggcattggaagagagcagatgccaggcaaagtgatcttgtgtaggtctgtttttggttttgtttgaattctgagtactcagagttaccaaaactgcaatgtctgagggcacccttatctttgacactaactgcaaatttaaggggattcctaaatccgtccttagattttataattcactagaggaattcacgtaactcactgaaaactgttattgcatgactgtggtttatcacagggaaaaaacacaggttaaaatcagcctaaggaagacacacagggcagagtctaggagggtttcaggtgtgaagcttcgttgtcctcaggaggctgcgttctcctgtgtcaatgtgggacaaaacacatggggtgttgccaaccagggaagctcacccagttaaggaaaaattcctgtgaatcacattaaatcaggaagaaagcctttattcaggattgttgttacaggggagggagactgagcccagctcccaatacagtaaagacagagggggagtcacagccaacaccagagtgaggggcagcagatggaacaggactgacaggaggcaccagagtcgggggttcatgctaaactggcctaacaggattttccctaaaggcaggtcagacactcacccatcaaggggcaggtgaggagagtgatcagatagcaagtgtgctcagacagtaagaagggaggaccctccctaaactgactcggggggattcttgctgagccagggttgtgcaggcccagcaagcacgggatgggcatggaaggccaaggttggtgcctagaggagaagaggctcagaagagcccaactggagtctggtcaaacagaaagtctttctcaacccatgccttagtgtccagagtgtttgctggggcttgaccacaggctgcactcatggctgacctggagtttccagcccctccctgaggtctcacacctttagtccccagatcctctggtggtgagaagagatacccaatagccccaaacccccatcatccatcacatttgctatactgtcctgtagccaaaccaccagggaaacaaagacattcctaccaggcagggcattccaggggcctggagatcacttcgcaggggtaggggacaatgggaagacctctcctgggataaagttaattcttcactgcgcaattgtagtgcagtgaagattctattcccagaggccggggaaggtttgcaattgctttggtgcagtggggcatgggtaaacttgcaccttagctataacagcagacagaacaaccatagtacaaatacaggtagtcagttgtgcaactgtgtattggtagacacaatgacagcacatcaccggctaaccccacaatatggggtgactacctgtacaacaatgtcaccaagcccttgggttaagcaatgatacatggctgggttggtagaataagtctctgcatatgggtgcctaccaatccccatggagatggagatggctgtgggcctgtgtcacccacccttggccttatttgccattcaactggactggcagatgcatctcagggcatccttaattgccacagtatatagttccccatttagacacgacccccagtaactggaaaacggtaaaagctagagattaccagatatgtgcatactggtggttctaccccttggccatctttgcctccaaagtggcaactgtaaatgcagagctgcaattcgtgtgctggctaaacacacagctgcagccttcaatgatactcaccatcgttttacacttcccaatcaagaaaccacccagatcaggcatgttcctctgcaaaatcgtatgacccaaaatcatacaactgctgcccatggtggagcttgtgcattaattaaaacaaaatgttgtgtatatagccctcattactctcataacataacacaggctctgctgacgttagatacccagagtccagccacagagtctttgtcttatgatcttatcacctcatggtttaatcaactcccagacacgtggagaaactttgtatctagcgtaattgcaattgcgttcataatcctttgttgaggttagtgttgctgctggggtgtctggctgcaatgctcttccacaaaactggccccaggaaaatcacagaaaaacagtgtgatgagattgtgagggccattcaaggctatgcaggggtgtggagagcatggtgggcatgtcccgtcagacagcaataactgaagcatcccctaagaataaccctacattccttggtgaatttttgctcagtgttccaaggtatggatcccgggaatggccaatccagatgtttacatcatacttatgaagaactctgttccttggatcagaggttgtgcaaggaatcaagaccttttgttttgggctaggtggaggtttcctggcagaggtgctaagtggaggttgctctgggaagaatatcatataacctgcatgcatttgacaaacaggaggggatttcttgtcttgcctgctgctcctgggcaacctgtacataagctccctgaataaagcttatgtctcacctgctgtctccaggtcttttcttctgtctctccaagtctgtgtcctgtcagctcattagcataggggtccagcatgacaaatataaaacggtgtttaacattctttggattatgtttatataaatgtgttattaatatgtgttccaaaattgtacgagattctataggtctaatatgtcttggcatatgttatcagaaactattattattattatgttaagtagttgtttgccacagaaataaagtaatttccttgtcgaatgtgtctttaccaatgctgttctcatacttttgttatctgcaaaaagtgtttactttacatctcaaaaaacagtttatgatcagctacagattgtgccatcggactaagaaaaaaataaatcttccaggactgtaattcaaaagttgatgtggtcatgaagattgctaacccaatatcaagtggaagaaggttattacatgggaatgaattaatggagaacaaaaataaatttttaatgactttttgtttaatatacgactgattcttttgttttgtttttcttagtcaagaaaacttctttttccctttgggctccatgtagcttttaacaattgaataaagtatactcttgtgagcaaaatttgaagcatatttctttctcactatctgatttctccagaatttggaaactatttgtgagtattcttagttcatggcaatagagttatttgcataagttcagttggaatctgttttctttcataacaggacacaactagagacactggttattttaccaaggctttgactggcatggcatatttccacatgtacgtaggctgctttgagtaatggtggctggcttatagagccgatgaaagcctctttgaaaaattttcctcaaactttgcctatacagttcctttacagggttcctgtcctgtggtaagtaaagaatgtcactttctgacaggcccaggaagcccaagttaccttgggaccttgaggagaaaggaactcacctaatatatataggcatctgcaggcaaatataaatcactggctgagcttgagattttaaaaggcctactctgagatatcttatgaaaaagaaaatattgtagcaaagtcaatttccaaaaggagcccatatgccaaataagtattcttgctgcactttatacaaatgatcaggccaagaaccatcagactaaaacttctgttgcaaataaattagccctactatgatttgtctttggtagaaatacaggactagagagagaaaaggtatgtttcaaaagaaactagagaatgcctgttattggattctagctttctccattgttttctagccgtattgtttgtccacagtttatctggactacatactgaattctttcctggccacaagtctccaaactaatattttgcttttctttttctctcatttttctgacttggaatcaccagaaatccaaactgtgcttttcttaaagtcctgcaaactgaagcttgaaaactgtgttatagtgaaggaagagaaagaccctctcatattatttttatattgttttgtactcagtacctgttttaagaaaaaacaacaaggaagtaaaaccaaagacaggcagcccggcgccaggcccgaaaccaggcctgggcccgcctggcctaaacccattagttaaaaatcaacttatgattcagaagccgatgttattcatagattccttacattatgtagaagaacattgtgaaactccctgccctgttctgttcccccctgacgacctgtgtatgcagcccctgtcacgtaccgcctgcttgctcaaatcaatcatgaccctttcgtgtgaaatctttagtgttgtgagcccttaaaagggacagaaattgtgcactcagggagctcggattttaaggcagtagcttgccgatgctcccagctgaataaagcccttccttctactactcggtgtctgagaggttttgtctgcagctcgtcctgctacaatagaattcagaccaaactcgtgaccagagactcatttgcttctacagtgttttgtccaaaagatgttgaagaacggccaggcgcagtggctcacgcctgtaatcccagcgctttcggaggccgaggcaggcagatcacaacgccaagagatcgagaccatgctggccaagatggtgaaacgctgtctgtactaaaaatacaaaaattagctgggcttggtggtgcgtgcctgtagtcccagctacttgggaggctgaggcaggagaatcacttgaacccgggaggtggaggttgcagtgagccgagatcacaacactgcactccagcctggcaacagagcaagaatctgtcaaaaaaaaaaaaaaaaaaaaagttgttgaagaacaaggagaaaacgtgaaaggaaaatcaaatcttgggaccccaaaactcactggaaacagttaagcttagaaacggagtcactccaaaacctgcctttgtttttgcttctaagcagatatttgcgaagacaaaaggcaacatgttccccaggtagcctccttcacaaattgctcacaaggaaactccttgtgggtcccagcagtttttaccctgaggcagactttgtgtaatttcattgtgacaatgcaaattagcaacttatctttactggtacatgataaataacaagacttctgcccaccctcagaaaaatgcacatatgcctgcttcctctactctatgttcatttttatcttatataaaatgtagacgaactgtgcatgagacgaatgaataattgactgttcctctaccccctcctttcatagacaacctgtggattcaaggagggctaatcaaagcttcacaagaatgtgaccactcacctcattacctatcctgtcttttttcctttcctccttccactcctgcctgattttacacatttaaatactggaggcctcaaaaccctctgtgaaaaacgagtggaccccagaacctcctgtgacttgtgtgactttttcctgggtgcatcctcaaccttggcagagtaaacatctaaactgactgagacgtgtcccagaccctctttggtttacaagtcttgcctcctccctgagttgctggatgaaagcaacgtcctctcttcttgcctcagtttcctcatctgcaaaatcagatcataatcctggcccattgaggggatgattataaaactcaatcaaatggagaagcatttgcaaatggaatgtattgcaaagtgtattgtgcagtccctgtgtaatcaccattctcttcctgcctcataagctggtgtgtgtgtgtgtatgggtggggtgaggtggacacgatgcccccagagatgtttgctcaggatgaaataggcccccatggaagggtcaggttggcttctgtggtttagctgcctttgaggcccttctgcctggggcaaagcacaaaagtccaatagcaatctggttgcatgacttcctagtcatggaagtgtggctgagcagtggtctctagtccctccaccctgtgtgcctcgggagtggaacacggggcagtggcctctgctggggaggatgctgggggatctctgaaaggaggcaatgcctgattttgtcactgaacgatgagcatgatttttccaggcggtggaagcaggtgctcccggcagaagaccccatataagcaaatatctagaagccacaaggcatggccttcaacaagagcaggcctggtgcggtggctcatgccaaggtgggaggatcacttgaggcctggagttcaagagtagcccagtcaatatagtgaggcaccatctctaatataatttttttaaaaattagctgggtggttggctgatacctgtagaaccagctactcaggaggctgaggtggggggatggcttaagcccaggggtttgaagctgctgtgcgcgatgactgtggcactgcaattcagtcttggtgacagactgagaccctgtctcaaaaacataaccaaaataaccccaacggcattacaataaatatacaataagcatccacaaggcatgtgtgggagactgtgcttatgccgatggcacgggcaggagtaaggcaggcatcaggggaatgtggatgcacgggaggatggggagtaatctgcagggtcccatagtatgtcagtggcaggtctttctccttgagaccacagcagacccccagccctgaggatgcgaggcaggtgggttggatgagagggatctggatgtctggtctcaggctgctcctctaagggcagcagcaaggagggtggggctggactgaaggtggaggggagcgtgtttgctgtgcttggtcatgagctgctgggaagttgtgactttcactttccctttcgaattcctcggtatatcttggggactggaggacctgtctggttattatacagacgcataactggaggtgggatccacacagctcagaacagctggatcttgctcagtctctgccaggggaagattccttggtaagttggggacagttgacctgcctccatcttattctcacagcttttgtagataagctgggagaggttaggtgactggttcagatagacaggaaagtagcggcaaagcctggatttgcacccaggcttgagtctgattgcttcccctctcctgctgggctcttaaactatagagggttggggaaacagctcagatgggttcacaaagctccctgggctcagccctggttttgactgctgagacacgactgagtgaacccagaaggaaggtttgtgttgggggtgcccatctctttgggaaatttgaaggaaccaaagaaggtggaggagaggaggtgacccagatcccagcctgttcttatggccaggccacaccaaggctggccccagggtgctgctgctgaggcccaatgggggcaacagaattttttttcaggtacaaggagttcagaggtcatctcacccaccctgagtctgagcaccaacttgtgccaggccctgtggggaaactgaggccctgggagcggaatgacttgcccagggtcccgtgtcaggaggctgagcaggtagatcataggactccacgtctctggccctcacctctgtccctctgttcagacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgtgagtataactacaggagtgagagcttagatctctgtgttcatagaaggagaatcaaacctggaaacttttggattattaaaatcaaacatttttgcttcaatattagagtcacaagggcagatgttggcctcccctctgccctccaagagctgtgtgactctgggaaattcacctcccctcccagcctgagtattttcccctgtaaaaaacctgatagagctgccaaaagtccatgaaatcaggggggtaatttctgtgaaatctgagtcatggtcttatttgttcttcaccaaaaagagatgatgaagcctgtaaccccagtgctgtgggaggcagaggcgggaggatgacttgaggccaggagttcaagacagcctgggaaacacaggagatgctgtctctatgaaatcaaaaattaacaaattagcccagcatggtagtgtgtacctgtagtcccagctactcagaaggttgaaggaggcggatcacttgagcccaacagatctaggctgcaatgagctaggatggtgtcaaagccctgcagcctgggtgacagagcaaaactgtttattaaaaactaaacgaaaggccgggcgcggtggctcacgcctgtaatcccagcactttgggaggccaagacaggtggtcacgaggtcaggatatcgagaccatcctggctaacatggtgaaaccctgtctctactaaaaatacaaaaaaattagccgggtgtcgtggcgggcacctgtagtcccagctactcgggaggctgaggcaggagaatggcgtgaacccgggaggcagagcttgtagcgagcctagatcgccccactgcactccagcctgggtgatagagcgagactccatttcaaaaaaaaaatgaaatgaaaatggtgatttctcaggaggagcacactgtctcaacccctcttttcctgctcaaggaggaggccctgcagcgacatggagggagctgctttgctgagagtctctgtcctctgcatctggtgagcttggctcagagccctgaggcgggagggagggctccctgtctgggctgcacaattggactgggcttgggctgggccagggccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaagtggtacccatctcctggcctgtgtgtgatcatcgaatgagacacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcgggggggggggggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacggaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtattagtcaggatggtctcaatctcctgaccttgtgatccacccgccttggcctcccaaagtgctgggattacaggtgtgagccaccacaccgagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaatggtggtgatggtggttgtgatggcagcagagtggtgggggccttggcaagtggtcggtgctcttccagaccaggggacaccgatggaccgatgaagttccaggggaacttgaagtgctgtgttggaaagaggttaatttgggaagaaaggaaaaatgaaaggagatgccaggaacaggtcaaggaaccttgaggtgtgtccaggagttcaaccccgcttgtggtcacgagacctcgcctctctgagcctcagtttcctcatcagctgtagaagggtacctggacaaggtgatgtctcaggtccacccagctctccccatcttgtgtcctggagacttgggtccaatcagcactgactgatggctgtgcctttgtggtgccgatggaggctcccctgggctctgggtgcctgacttcccttcctcatgatccttcttccagggtctcgggaaacgaggcttccatggcccctcctgcttgctcactggactctcactttcccagctggtcatttccctgagacctcaaaaccccaccaaccccactggggcacccacagaaagcttgtacatgtctggctctggctgagcacaggtgtggtttccatctgcgagtcagagcccgggattgacatgggacgctcgaggctgactagtgtcagaggggcctgtgtgcagattgggagaagattatcgagtaatagaggggcaaagagggacatccagacagcaaacacccccatccagtctgtcctcacgttttgcccagactcctgcaagaacttccagaatggtcttccatgtgcaactgcccgtccctgcccatgtcctggatcattctccacactgcgccaggttgggctttaacaagatcatgttttgggtttttgggggttttttgtttgtttgtttggtctcactctgttgtgaggctggcgtcccgtggcatgagcatggctcactgcatcttggacctcccggcctcaaactacccttccaccttgaccccctgagtagctgggaccatccgtgtgtgccacattgcccaggctggtctcaaactcctgagttcaggtgatctgttcgccttggcattccaatgggctgcaattacagacacgagccaccgtgcccacctaagaacatagatttgatcgagcacccacttctgaccattcaatggcttcccattactcttagcacaaagatgtaggccatgatgctgcctaaagtagcctgttgcggcctggggtcctgtgaaggaagagccagaggcaacgttctggtgcagagggtttctaggaagtgattctaggagcagaactgaggatccaggagggaaggaggaaacgttgatacaagaagtttttgaatgggccatccatatgggcaatgagaccttctgaggtgccttcaaggagcgtcctcagaatctttgtttccagggaggagacatggaggcctttatccactgctttagctgtgtcccaggggttctggtacattgtgtctttgttctcattggtttcaaagaacttcttgatttctgccttaattttgttatttacccagtaatcattcaggaacacgttgttcaatttccatgtagttgtgcggtttttagtgagtttcttaatcctgagttctaatttgattgcactgtggtctgagacactgtttgttatgatttccattcttttgcatttgctgaggaatgttttacttccaattatgtggtcgactttagaataagtgttatacggtgctgagaagaaagtatattctgttgatttgggacggagagttctgtagatgtctgttaggtccactcagtccagggctgagttcaagtcctgaacatccttgttaattttctgtctcgttgacctgtctaatattgacagtggggtgttaaagtctcccactgctattgtgtgggagtctaagtctctttgtaggtctctaagaacttgttttatgaatctgcgtgctcccgtattgggtgcatatatatttaggatagttagctcttcttgttgcactgatgtttgttggtttaaaagatcttttttgatctttgttggtttaaagtctgttttatcagagactaggattgcaacccctgcttttttgtttgtttgtttgtttgtttgttttgctttccatttgcttggtaaatgttcctccatccctttattttcagcctatgtgtgtttttgcacatgagatgggtctcctgaatacagtacatcaacgggtcttgactttatccaatttgccagtctgtctgttttaattggggcatttagcccatttacatttaaggttcatattgttatgtgtgaatttgatcctgtcatcatgatgctagctgattattttgcacattagttgatgcagtttcttcatggtatcattggtctttatattttggtgtggttttgcagtgtctggtactggtttttcctttccatatttagtgcttccttcaggagctcatgtaaggccggcctggtggtgacaaaatccctcagcatttgcttgtctggaaaggattttatttctcctttgcttatgaagcttagtttggctggatatgaaattctgggttgaaaattcttttctttaagaatgttgaatattggtccccactctcttccagcttatatagggtttctgcagagagatccactgttagtctgatgggcttcccttcgtaggtaacgtgatctttctctctggctgcccttaacattttttccttcgtttcaaccttggagaatctgatgattatgtgtcttggggttgctcttcttgaagagtatcttagtggtgttctctgtatttcctgaatttgaatgttggcctggcttgctggttggggaagttctcctggataatatcctaaagtgtgttttccagcttgtttccgttctccccatcactttcaggtacaccaatcaattgtaggtttaatcttttcacatagtcccatatttcttggaggctttatttgttccattgtcattcttttttctctaattttgtcttcacacattgtttcagtaagttgatcttcaatctttgatattccgcttgatcaatttggctattgatagttgtgtatccttcacgaagttctcatgctgtgtttttcagctccatcaggtcatttacgttcttctctaaactggttattctagttagcagctcctgtaacctttcatcaaggttcttagcttccttgcattgggttacaacatgctcctttagctcagaggagtttctcattacccatcttctgaagcctacttctgtcaattcgtcaaattcattctccatccagttttgtgcccttgctggagaggagttgcaatcatttggagaagagacattctggtctttggaattttcagcgtttttgtgctggtttttccttatcttcatgaatttatctttgatctttgaggatgatgaccttcggatgggcttttgggggaggggaggtccttttagttgatcttgatgttattgctttctgtttgttagtttttcatctaataatcaggcccctctgctgcaggtctgctgcagtttgctggaggttcactccagaccttttttgcctgggtatcaccagcagaggctacagaacagcaaagatagctgcctgctccttcctctggaagcttcgttccagaggggcactgacttgatatcagccagagctctcctgtatgaggtgtctccctcaggaggcacgggagtcagggacccacttgaggaggcagtctgtcccttagtagtgcttgagcgctgtgctgggaaatgcgctgctctcttcagagccagcaggcaggaacgtttaagtccactgaagttgcgcccacagctgccccttcccctaggtgccctctctgtccggggagatgggagttttatctataagcccctgactggggctgctgcctttctttcagagatgccctgccagtgaggaggaatctagagaggcagtctggccacagccgctttgctgtgctgtggtgagttccgcccagtccgaactccccaccctccttagcactgtcagggaaaagctacctactcaagcctcagtaatggcggatgcccctctctctaccaagctctagtggcccaggtcaacttcaggctgctgtgctggagcgagaatttcaagccagtgtttcttagcttgctgggctccgtgggagtgggacctgctgagcaagaccacttggctccctggcttcagccctctttccaggggagtgaacggttctgtcttgctggggttccaggcgccactggggtacaaaaaaaaaattcctgcagctagctcagtgtctttcccaaacagccacccagttttgtgcttgaaacccagggccctggtggtgtaggcacatgagggaatctcctggtctgtggattgcaaaaactgggaaatgcatagtatctggactggatagcacagtccctcatggtttcccttggctgggggagggaggcccccggctccttgcacttcctgggtgaggcaacaccccaccctgattctgctcgccctccgtgggctgtacccactgcctaaccagtcccaatgagatgaactgggtacctccgttggaaatgcagaaatcactcgccttctgtgttgatcttgctgggagctgcagtctggagctgttcctattcagccatcttgccagatctcccctctatcttcttttttttttttttttttttgagacagagtcttgctctgtctcccaggctggagtgcagtagcacaatctcggctcactgcaagctccgcctcccgagttcacgccattctcctgcctcagcctcctgagtagcggactacaggctcctgcttttttgttttgttttttgtatttttagtagagacagggtttcaccatgttagccaggatggtctcgatctcatgacctcatgatccgcccgcctcagcctcccatagtgctgggattacaggcgtgagccaccacgtctggccgatctcaccctatcttaagctatttccagaaacagaatgactaggtcagagggtattaacatcgaaaaatgtttccatacctagaaccacatcgttatgcaaataaattgtatcaatttacactcacaccagctttacaggagggtgttcattccttcagtcttaagaattctcagtattctttctctttaaaaagaaaaacagatctttacacggagaaaagtttttcaagttcggcttgtgattatcctgcctgcaaagatgagggaaaagagcgaaagttgatcatgtttaggcattactttaagaagacaaaagagcatttttcaaccaccccttctgagaccagactaaaatcacagtcaaggcacttataggtataatagcagctgatatggcttggggctgggtccctgcccaaatctcacatcaaactgtaatccccagcattgatggtgatgcctgctggaaggcaactgggttatgggagtggatttcccctttggtgctattctcttgatagtgagttcccttcaccttctgccatgattggaagttccctgaggcctccccagaagctgataccaccatgcttcctgtacagcccgcagaactgtgagccaattaagccccttttctttataaattacccagtctcaggtatttcttttcagtagtgtgagaatggactaatacagcaactaatgctaatagtggcgaacaatgtgtggactttactttgcaccactaactgctctaagatgttagaaaaaactcaccgtactctttcaagaacctctgaagtgtgtatcatttgtaccaccattaacagataaggaaactgaaacagatgttcaatgacttggccaaggtcagaaatctactgatggctaaagactcggttccgacccagtcatatggattccagaactcacacattgccttggtaccctctctgctgacaaaaaacttgaatgagaccaacaggagatcagagatttcaacagctatttagaagacagaactgactgaagaaatgacaaccgaataaagatgggtgaaggcagctgcgatccacagcaatatggagaggacatccagccaagaagaatcacctgctaggcagagcctcagagagaggagaagttcaccagccccatgacccatataggattcaaggcagcctcgagtctacaccaatgaaaaaatcagagagttcatgactcaatcaaaaagccccagaaataatatccttgtattctgacactttagggggttcccatccaatcaccccacaggtaagcctgccagtggacttgtcttcctcctacataggaatggatctaggatcagatatatgagaaagacaaaataaggaaaagagaccaagactaacaaatgcaaaatgagtccagaagaaatgaataattttgaaaatggacaataattttgaaaaaatcaaactcatgtccttggagagatttaaactcacgctggccgggtgcagtgactcacacctgtaatcccagcactttgggaggccgaggcaggcagatcacctgaagtcgggagtttgagaccagccttaccaacatggagaaacccctgtctctactaaaaatacaaaattagctgggcatggtggcgcatgcctgtaatcccagctactcgggaggctgagacaggagaatcgcttaaacctgggaggcggaggttacggtgacctgagttcgtgccattgcactccagcctgggcaacaagagtgaaactctgtttcaaaataaaataaaattgtatgcttgagaacaagatgtactgaaaagaagggggaaacaatagaacaaaaaaaaattcttgggaattaaatgattgacaaaataaacaactcaagagagggttgaaaaagtctagaaaagcttccagaaaataaactagaaagatgacaggagaaatggagctaaagcggaattgaaatgttaccatacatcatgacttcctggaaagctacttgagaaagagctacagagggagtgggaaggacgtgcgtgtgtgtgcacgtgtgtgcacccatggtgagtgggtggggataaccaagagagaaaaagacatgggatccaggaaacaagcaactcaacccagtgagaagggaatccaaggatcacggctgagcatgcagcaggcctaaagaacaaccagtccaggatggaataagaagggaagggttctgtggggacttcacagagtacctcatatgattcacaatttgagggaagctgaggaaatcatgaaggcaaacagtgcaaggggggggaaaacaaaggcaattagaaacatcaggaaaaactaaagctgtgccacaaagcatgtgcagccatattgtacaactcaactctatagtaaacagtatttaaaacatcacaaaaatgtaaacacgcttgtttgatttttaactttgagcacaaaacagaacatttaaatatgagaaccaaataaacttgttgccaatcagtaccaaaattaaagtacaatggtagtgcttgggaagggaggcactgaaaaggaagattaatatcctcgttttataaaatggggagtcaagaaacactggccatagtgagggcgtaagaaaaacattgcaagtaaattgtttacaaagtttctaatggggattataaaactagcgatataatattagaagaaggtggggaggggagttagaagtgtaaagataacttaataataataaataaataataagtaatgaataaaaatattaataataaaaatagtaataaaaaaattatatcctaataggaagcaaataaatagtgatgtctaaatttcaaaatggagaaaaataaaaatgcaatagcttatatttattgaccatctgctttgcaccaggaaccttctaaatgctttgcaggcattaacttatttttagttctcacaacaactgttagaaagatactattatcacctgcatgcttcagatgaggaaactgaagctcagagaagttaagctagtgacagcacctaactagtgacacccggaattcaaactcaggcttcctatctccagagcatgcactctcactatttcatgtcccagcataagaaaattatttaaatatatttatttactccctaaagaaaaagctagggccgggcgtggtggctcacacctgtaatcccagcactttgggaggctgaggtgggtggatcacctgaggtcaggagttcaagaccagcctgggcaacatggtgaaaccccgtctctactaaaagtacaaaaattagctgggcacagtggcatgtgcctgtaatcccagttactcgggaggctgaggcaggagaatcgcttaagccagggaggtggaggttgcagtgagccaagatcgcgccactgcactccagcctgggtgacagagggagactccgtctcaaaaaaaaaaaaaaaaagaaaaaagaaaaagctaaaattgggactaattgctcttaatttgggtaagtggagccgtctgtactaattgattgattgattgggaaggggtaagtagagccctctgtactaattgattggtcttaaccatctgctgcactcacttattactttatttttttaatttaagaggacagaattcagtttatagtagttagtaactgctaacctcaatagcaagttaggttctggtgtcaccttccttgaaggttatggagcaatgtgaacatgtgccagtgagaaataagcctgcctctgatatggaagtgctgggaagggaagcatgtagtccctttaaatgatatggatcccacctctgggaggcctgtaatcccagcacctgtaatcccagcactttgggaggccaaggcggatagagcacaaggtcaggagttcgagaccggcctggccaatatggtgaaaccccgtctctactaaaaatacaaaaattagctgggcatcgtggtgggtgcctgtagtcccagctactcgggaggctgaggcaggagaattgcttgaacccgggaggcagaggttgccgtgagccatgattacaccactgcaccccagcctggagacagagtgagactttgtctcaaagaaaaaaaaagaaaagaagtgggggcctcacacacagtttcctggataacaggaactattgtaagagatcccaccaaaccacaaccatgcagaatgaatcacagccctgcacaaaggccacctctatgaggacatctgcccaacaactgtctgtttaaccttgagctaaggtgacccttgttattaattcttgtacctagggatcattatttaaaataacttacataattctccccattttggctttaaaaacctctgctttcagccgggcgtggtggctcacgcctgtaatcccagcactttgggaggctaaggcggatggatcacctgaggtcaggagttcgagaccagcctgcccaacatggagaaaccccatctctactaaaagtacaaaattagccgggcatggtggcacatgcctgtatttccagctacttgggaggctgaggcaggagaattgctggaacccgggaggcggaagttgcagtgagccgagatcgcgccactgcactccagcctggctacaaagcgagactccgtcttggggcaaaaaaaaaaaaaaaaaaaaaaaaaacaccacctctgctttcctttgtctccctgagtcggcctgtggtcccaccatggggtgtcctggcacatcatgtattcccagatttacaaatccttctgctcattccagaataaacttgttatcttcagagactccctttctgttgttattttaggttgacgacagactccctgaacgtaatctcatagtggagcaaccagaatggggactgcagactcaaatccaggtgagaatcaggtgtctcttaacttcagggacgtgggacgtgagcagagaccatccatttggagattccgaggatctagtgactaagaatagggctcagtttcaccatcaacaccgcaggaaaattcacccaggatgtctgcagctccagaggagggggcttgggccaaaatcttgggtccatatgcaatttcggccactgagaaggcaaacccaactcgaagggggaaatgaaccctgaaattgctttggaagatgtgcggtgacatcgccagcaccacctagtggaagctggaagtgtggacagccctcctcacagccaccacccccaccccgccctgccccgccaatggagaggtgtgcttggccaggtcatgcccgatgtcattgtctgtgtgcaccatgacagggaccccagcgccctgttctgctctttttcaaggcaccctggaaggaggtggcgagcttcaagctgggcatttgacaatgggggcttctgaaggcatcagtggctagcggagacaaacaagcctaggactgcaaagtgcaggggaagggaattgtgtttcatgcccacagcccctggggaccccataggaggctgagggagcagccactggtcccggccactcacagcccggccactagcagtgtctcatggacaatcctttttgtctttcctcatatggaaaaattgggccctgagtaacaggtgtcagcttcaggaaggttcagaagtaggtataaaaatgacaaacacaatcaagctcatattttcctgctgaagtctagacaaatgtgtgtttcattttgatgcacatataacatttaagagaactggactcatacacagagttaacagagtagtttttggattcagatttgaaataggtaatcgagtaattgatatagatgcaggatttcagcttgaatgcctctctgctagtaggtactgagggtgctgcaaataagctttagcccagggagagggagaagcatctagctcagtggatcccaaacaggagaaatgaggagtggagggtagggagggtgctgtgagcacccacagcaacaggatctctggaacatgcaccaagggacatgcgccaacctctatccccttccctccagcagccaagagacaaaggagactcttgtctggagtcattgcggtgccaaagcatgaccttaaaaatgatagcaacttagctgggcgtggtggctcacgcctgtaatcccagctctttgggaggccgaggtgggaggatcacctgaggacctgaggtcaggagttcgagaccagcctggccaacatggtgaaaccctgtctctactaaaaatacagaaattagccgggtgtggtggcaggcacctgtagtcccagctacttgggaggctgaggcaggagaatcatttcaacccgggcggcagaggttgcagtgagctgagagcgcaccactgcactccagcctgggtgacagagcgagactctgtctctaaataaataaataaataaaataatagcacttagctgctgtggaaaactatatgacggttctttgaaaacttaaacatagaattaccataggatccctcaattccacttctgggaatatacccaacagcatgaaaacagggacctgaccagatatttgtacagtcatgctcatagcagcatcgttcaccatagccaaatggtggaggcaacccaggtgtccattgacagatgaacggataagcaaaatggtacgtgtacccacagggaatattattccgccttaaaagaggaaggaaattctgacccatgctgtaacaaggatgaaccttaaggacattctgctaagtgaaataagcccgtcacaaaaggacacatgctgtatgattccgttcatgtgaggttcttacggtggtcaaatttataaagataaggagcagagtgttggttgtcaagggctgggggagggagaatgagcagttcatgtttactgggtacaaagtgtcagttttgcaagagaagagttctgtggatgatggtggttgtgcaacaatgtgaatgtaattccacgaaactgttcacctaaaaatggttaaaaaggcaattttaggttatgaatatcttacagttaaaatctttaattaaagtcctttcaaagcccaacctttgcagaaaaaaaattatagcacctgagccctttttggtttgcagaacattttcacacacatagtcatacatgcttcaacgacggccctgtgataaaaacatttattaatttggcttcccagaggagaaaactaaggttcaaatggggtgaaacggccaggtgtggtggctcatgcctgtaatcccagcattttgggaagccgaggcaggtggatctcctgaggtcaggagttcgagaccaccctggccaacatggcaaaaccccatctcaactaaaaatacaaaaattagccaggtgtggtagtgcacgcctgtagtctcagctactcagaaggctgaggcacgagaatcacttgaacctgggaggcacaggttgcagtgagtcaagatcgctccactgctctccagcctgggtgacagggactctgtctcagaaaaaaaaaaaaaaaaatccaggtgtggtggctcacgcctgtaatcccaacactttggaggtcaggagtttcagatcagcctgaccaacatggtgaaaccctgtctctactaaaaatacaaaaaaattagtcaggcatggtggcgggcacctgtaatcccagctactcgggaggctgagacagaagaatagcttgaacctgggaggcggaggttgcagtgagctgagattgagccactgcattccggcctgggtgacagagtgagactccatctcagggaaaaaaaaaaaaaaaagattctgacaaaatgccatgaagatcgtttgtagatcttgtcttgctaaagtggagttggattcagagggttgggggcggggtctgaaatagtttctaagcagttctcacgtggagccaacgcttctggtgcaaggaccgccatccagcagcaaagatccagtgtactttacttaacagacaaggaagctagccgggaagggagtgacttgcccagggtgacagggcagggtggcacataggaagctaagggccagggaatgtgcatgcagctgttttgccaaaaatcggtcaccttcttaagctgacccagatagtgtccacttttttaaatttttttatttatttattttgagacagagtctcactctcgcccaggctagagtgcagtggcacaatcttagctcactgcaacctctgcctcccgggttcaagcgattctcctgcctcagcctcctgagtagctgggattacaggcacacaccaccacgcccggctaattttttttgtatttttagtagagatgttggccaggctggtcttgaactcctgacctcaggtgatccccctgcctcagcctcccaaagtgctgggattacaggcgtgagccaccgtgctcggccttgaaccaaggtttctaagatgctcttagcctccttggatctggcctagcccacctttccatcttagcttttctgcacaaccgcccacagctagctcagcctacgcctcagccaatctggttcccgacgatgcagagccggcattggctgcagaagccaggcctagtcctgtccagggccccctggccgcagacaaatgctacagacacggctcgtagcacatggttctctttattgtgatgctcagtggaaaacatctgtaaaccagcttactgtagtggtgacagctgcaacacatgctaaggcacttttattatataaaaaagggggtagggtgggagtttcactcactcctttgtgacagcaactgggacctgaattcagagctttgtaggcatatgcagcttttatatcacttcatgatttgagagtttgtttcctttaaaaaaaaaaaatgccttcttgccgtaagtctcaatgcagcatatacaaaacagttaggaatacaagtaaattcggcaaccagtgtagaccagtgaggacgagctactctcttctaaacaaaggcagtgagaaagactcggaattttatcatttattacaagaaaggggaaaaaagaaaaccttattttgctttcaaaaatacctgtgcaggtggcagatttttaaactatactgagtcaacggtgcaggtaaaccaccctcgggcccagtcctagagtagacacaagatcgcctgggagggccgctggcccctctaacgctctggctgtcagacttgggacaagtcccttaaccattaaatatatttggtccccaagagtgttgggagaagccactggaaggctgctggcctttccagcttgaccccgacagccttgctgtggcagaggcaggctgtcctcggtaaaggaggggagggggcattgcacttgagacattttagaatcaggagggagacagcggacagtggcgctgcctgggacagggtggggaggaatccactcctccccccaccccagccttctgtgccctgcacagaggtggaggcccagggcctgctccttctggaccgcccagagccatgggagtgggaggcccaaggggcagaggtgtgtgaggtcaccacgtgtgattgcaaacagcaaagaaaggaggaggagtgggggcgctggtggcagacgtcagggaggctgacgactgcgggggctccgactaccaaaaggcctcagtctgaagaaaaatagattcatagaaaactctggcccctccccgggggcctgccctgctcgcctcaacatcttgtgctttttggcaagagagggctgaggagcctgctggtcgctctctgcctgggcccgggccctgtctctttggtatcagattctgagcaggggagggagctggaaggggatgcagcagaggaagccaaatgccctcaacaacacctggagggaaacgggatggggggacggggcggagggcaggaggaggcatgttcacagcagtcccaagaaggtggggagaggcgtgctgcggggtctgggaaggggaggctgtggtgtctgtctgtccatccatctcaggctgcaggagaagaggcttattcggcaggtttggcctcagccccatccgctttgccatctacctcttcgtcggagccatccccggcgcctttccgggccattcggcggggcacgacaaacggcaggtccccgcgcctgggggcagaggtagaagcagagggtcagcgggcccggccaggccaggggcggccacagcacagcccacacatctcaaagtgaattcgagagggaaaccaggtgcctggctgctcccaccagaaagaagcaaagtggagtcttgggagccacagctgagctagacaggaccactctcaggaaagcaggcaaagcttcccgcaaaatgtttaggtgtcggacatcttcacacacaacagtagcacaaaaacagctcaggcaaacaggaccaattacaacaggaaaggcacaaaagtaagtgtaaaatgccatcctctgttgcaactcctataaaaccggtgaaaccaagacaggtaaacaggtgtgcctgttcacacagagtacaaagacaggcaccctctttctaccacatggcagaaaattcatatacaatactgactacttatgcttacaaaaagagccccatgaaggcctggcacggtggctcatccttgtaatctcagctctctgggaggccgaggcgggtggagcacctgaggtcaggagtttgagaccagcctgaccaacatggtaaaaccccgtctccactaaaaatacaaaaattagccgggcatagtggtgcatgcctgtaatcccagctactccaggggctgagggaggagaatcgcttgaacccgggaggcagaggttgcagcaagccgagattacaccattgcactccagtctgggcaacaagagcgaaactccgtctcaaaaaaaaaaaacaaaaaaaataaaaaaaacacgtaaacacataagaaaaaaacatgtaagaaatgagtatctcaaaaaacacaaaatgagagtctcaaaaaacccacaaaaaaacacgtaagaaatgagaatctcagagaataagatcctctgcttcaaacattcactacttcttgagtgttaacactccctgagaaacgcaaaggagcgtttttaacctctgtaggcattgctcatgaggctcacattcgttttgcagatatttaactgaggcacctaacatgtgccaggactgggccaggtggcctcaagcaacttccaattcaaaagacaatagacttttaggacagctgggaataaactacctagagtttactgtgtgttcaaaacactaagctaaagcctcaaaggcaaggagccagaaggggcagggattgctttgtgcagtcctttcttggtgacattcgtgccttgcttgtgggctctggttgaggaacaagctaccttttgagagaagtgccgaggcaaaggggcgggtgggcagggcggctcacctgagcttgttctttagggagctgacttcgcggttcatggcatcggccgtctcagtggcgtcctccagctcgcgctgcagtttccggcgggaggcgttggcccgctgggcctcctcttcggcctcctccagctgccgcttgagctgcttcaggcgggtagatgccttgtcggcctgcggagatggacgtgtggcccgtggccccggttaggggctctgggcgtgcagccagtcagccccactgccctgcctgtcaccccatctgctgcccagccccgctgcccttctcactgccccaccagcgcccacacctggtccttgtactgctcggcgttcctccgctcgtcatccacctgcagcagcacatccttcagcttcttctcggtccgacgcacctgtttgcaggctgcctggcgctccctgcatgacagacaaggtggctcagagggaacaccctccttcagagggtccggccaacaagccctaaccaggaccacccattccccggggctcactggcatctagggatcacgtagggaggcctttgctagacacctatgtgtacccggcttcttacgacgggcactgcaaatagccccatttacagatgaggaaatgggctcaggtaagggaagcgacacacctcaaagagcatctatgtaactggaaaagaggtctgggggcctactgtaaaccccattccctccaaggaagtctcagtcctgctgagcccataggacaactgtcctagtgggcaggacccccctgtacctcctgctctgattcactctcagacacagccaccaaaactcctggctttagaggtggaacagagaatcctgttcaaaccccacaagctcccccaaccacccaacctgtggaagggatgagggccccatcaggagggagggaaacagccccaggctcaggagacagagagctggttgtggcccagatttgggcaggactgcaggggggccagagttttttccaggacagctggggttgggcggggccaggggcacgtacttggtctcgttgtccagctgctcctccagctgtgcaatcttggcctcgagggcggtgatggaggccttgtacttggacttgacagtgccctccatctcctgcagcttgaccttaagctccttgttctggcgttccagctgctgccgagcattctcgttcttctgggcgtggctgcgctccaggttcaggtcggtgttgatctggtcgatctgcagaagaagggccagtgaccttggggagggctggggccctggctggagggcatgagcagggccagaggaaggtggcagcaggatcccaccaaacccttggggtccagagtcttgggtctcccagaaaagggaagattagaaacttctgaacacccaacacagaagccagagggggacctttcaggtccaggtgcctggacattttcccctaagcgcctggggagcagctggcacttggcctgtgcttctgccggctgggtccaaggccagctctgccgtggtggctccagccagagcccagagtgggagaagtcctggcacccacctgcaggttggccttcttcagccggtcgttgatcagctccgtgttgccctgctcctcctccagctcctcctccagctgggcgatgcgggcctccagacgccgcttctcctctaacgccagggctctgcggggtgggcgggagaagtgaggggcctaccctggggacacacctggtcccccccaactctgccccctcactcagctcaccctttgccgctgctgttggcgatctcgtcagccagctcatcccgctcctgctgggcctggcgcttggcacgctccgcggctgccagttcctgccacaaagacccagagtgtgacctaaaggcagccacagccccacaagaccatccttcccagccccaggcaccctcccctcaagcccttccccaggcccacctccccacgaagcccttcctccagaaaccctctagctcacagggctggtgcccccctgaagatatagcttaaacaccatatgtttataaaactcttacatttaagtgctaggaatcaagccaggtgccagggtatggcgataagtaagaagtgtcctggcctaaccagggagaccacgtggacagagtcactcagggcggcccctccctgttctgggtaagccagagcttggagtcagctctggaggccacaggcagatggctacaccctggacgcactcgcagccggcacatcacgctgcagggcaccctccagacctgggaaacacttcaggacgggctcaggtgcgacgggcagggcggccgaggggacgctcagaccccttctcaccaggcagcattcacagcaggaggtggtggtggccacaaagcctcatctcatgtgagggatgccagtttcacacacacacacactctgatcatacgagggagccccgctatgaaacggaaccctggagggaatccttatgtaacctgagagccatccccagccaattcctggagcccagtaggactccagccctgtcctcagctgaaagccccacgctgccacctgctggccgcagggcagcggtgccgctctccattgcagccccacccacctcctgcaactggatcatctcggcctccatgctcttcagcttcttctcgttctctttggcctgggccaggatctcctcacgagaggcgcgggtgtcatccagctcgcgcatgcagtccttcatctgggcctggggtggggacagaggcttggcaccccacccagctccttggccctccaccccaaccctcatgggtcacctcgccaacagggctcatggctggtgctccactcaatgctgtatttaaccaactaaccgtggtgacagggcaaaaaggcaactaaagacaatcatctgtgtatcccaccccgtaatgcacactttgacagtgttcgtcaccgtggacgtgagcccaagctgagcttcattttctactttctgtcccctcctgtgggccggaagccagtgcccatggtgccacccctaatgcgcacctgccactcaaaaccagtgcccagcctgccggtccatccccaccacaggcaggaaacacctttccttttgttattctcctgttacttcttttaacactaaagacctttgtcaaatagcctttttttccttttgcagataaatccgaaattgagattccccaaatcaaagagagtgactggctgtgtgcagcccgaccacaccagtaaaaaaatgccaccagcaatcagagcatctatgcccacaaccttgaccacaatgaagttttaaagtttttgtgggttttttttttacacttaacattttttttttggccgggcgcagtggctcatgcttgtaatcccagcactttgggaggccgaggcgggtggatcacaaggtcaggagattgagaccatcctggctaacatggtgaaaccccgtctctactaaaaatacaaaaattagccgggcgtggcggcgtgcgcctgtagtcccagctgctggggaggctgaggcaggagaatggcgtgaacccgggaggcggagcttgcagcaagccgagatcatgccactgcactccagcctgagcgacagagcgagactccgtctcaaacaaacaaacaaaaaaaaatttgttaaactaaggttattcttgttacatgatatggcgtatcagagctgtttttacgtgttaattattctttaattattagtgaggtgaagatttccaagtatgtgtcccacactccgggctgcttcttggaaccatcgccccagagcccagaaggctgaagggtgtcaggacccgggtgattctggaagtctgcattaagtgagaccttcttgaactccacccatgtctaggcttgtacttgtttgcttctgtgttttatgtacccagtcatacaccgttttgcaagtttgctgttggactatcatgtttccactcacctctgagcctctgagtctctgtcagtgagatggggctggaagcacccaggaccttcccaggaggtgccaccctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggccgagtcgatgtgcgcctccaggtccttcaggtccatctccagcttcttccgggcggccactgccatcgagcgctgcttcctctcgtcctccagctctgcctccatctcccgcacctgggggaaggaacatcaacaacttgggaagctggacccactgggagaccctgccctagctctgaactcaggagcctcaggccagttctgcaggatccatggggcctcgggaaaccagtggggattactgaccataagaactctaagaaagtgagtcactgaaccccgagacaggaggctagaaagaaggaatatgggaggggaggcgtggtcaaggggccctaacacaatccaggtggaaggagagaacagaagcctgcgtgaagccaaggcagccttgggcacccatggggtagcaggaggccatgcacacctgtctgaccagctgcttcttcttctcctcgctctgctcgtcccggccctgcaggtcccgctcgaactgggccttcatggcctgcaggttgacctccaaccgcagcttggcatcttcggtggcctgcagctcgtcctccagctcttccagctgcgtcttcatctcctccacctgctgctctagggcccgcttggacttctccagctcgtggacctgagccccagagagcccaagtcaggagcaaagggactggcaggtacctgggtctgcgcgacccggagtctgtgcacacaccgaccctctgtgatgaccccactcgggcccttcccaagacctggctgccaggcccaggactcacactcttgcccacatcatccttggagctcataaggtcctccatctccgtgcggaactgcttgttgagccgctccagctccgccttctgctccatggcttcctccagggcccgggccagcgacagagccttggtctccttctctcgggcctccgcctcagcccggtcgcgctcctctgcatacttggcagagatggtcttctcctccgccaggagctgggaaagaggtgggcaccatgaggctcagagctacggcccccagcagggcagggcagctgggcctaagctccctggggaaggaggagcccagaggccacggtggagaggagcaggcctaggaagcacaggcccagggctgtgcccaggacaatacacacagtcccgtgcatcctcatgatgggatgactgccgactggagcaggcactactgcgaacaccatgttgtaacgtctgtttaattttcatcacttactaatcgcaaccctttatggcacgctgccccttccatgagagccctccaaacctgtaagagctttggttctcctgaaccacagctggcatttggttggcacttttcacgaagtgaatgccaagctggctgccaagaagcctgaaccccatttgtggtcttctctaatgacagctgctgtcccctggcatctgttctctgtgtgcacccacctggctctatcctatttccccaccttcccttccttttggcccaaaccttaattatcccatgggttgctgaccatttcctaaagggccagatagtgcattctttagagtatgcaggccctacagtctctgcagcaatggctcaaccccactaccacagcacaaagcaaccagagacaacatgagaaccatggagcgtggctgtgttcagtctatcgttccctacaaaatgcaggggccggatccggctaccacagttggctgcccgatgtcttctactgttctatcctgcccccgagtccacatccccctcagctgctctcagatcttttggaataaggaagtgatatgaatgcataaataaatcgtttaaaagacagtcaaaccgcaggagtttgagaccagcctgggcgatatggtgagatccctgtcattatgaaaaacatctaaaaattagctgggtgtggtggtggtgcacgcctgtggtcccagccactcaggaagctgatgtgggaggatcacttgagctgtggttgcaccacggcaccccagcctgggcaacagacagagacagtctccaaaaaaaaaaaaaaaaaaaacccaaactattttaaaaaaacccaaactataattaaataattataataatgtaatgatataatgataattaaagtgattttaactcagtgctcaatggagcccaggctggagtgcagtggcgtgatctcggcttgctacagcctccacctcccagccgcctgccttggcctcccaaaatgccaagattgcagcctcttcccggccgccaccccatctgggaagtgaggagcgtctctgcctggccgcccatcgtctgggatgtgaggagcccctctgcctggctgcccagtctggaaggtgaggggtgtctctgcccggccgccatcccatctaggaggtgaggagcgcctcttcccggccgccatcacatctaggaagtgaggagcgtctctgcccggccgcccatcgtctgagatgtggggagcgcctctgccccgccgccccgtctgggatgtgaggagtgcctctgcccagtggcgaccccgtctgggaggtgaggagcatctctgcccggccgccccgtctgagaagtgaggagaccctctgcctggcaaccgccccgtctgagaggtgaggagcccctccgccctgcagccgccccgtctgagaggtgaggagcccctccgcccggcggccaccccgtctgggaagtgaggagcgtctccgcccggcagccaccccatccgggagggaggtgggggggtcagccccccgccaggccagccgccccgtccgggaggtgaggggcgcctctgcccggccgcccctactggttagtgaggagcccctctgccaggccaccaccccgtctgggaggtgtacccaacagctcattgatagcgggccatgatgacaatggcggttttgtggaatagaaaggggggaaaggtggggaaaagattgagaaatcggatggttgccgtgtctgtgtagaaagaagtatacatgggagacttttcattttgttgtgtacaagaaaaattcttctgccttgggatcttgttgatctgtgaccttacccccaaccctgtgctctctgaaacatgtgctgtgtccactcagggttaaatggattaagggcggtgcaagatgtgctttgttaaacagatgcttgaaggcagcatgctcttaagagtcatcaccactccctaatctcaagtacccagggacacaaacactgcggaaggccaaagggtcctctgcctaggaaaaccggagacctttgttcacttgtttatctgctgaccttccctccactattgtcctatgaccctgccaaatccccctctgcgagaaacacccaagaatgatcaataaaaaaattaaaaaaaaaaaaaaaaaaaaaaagacagtcaaaccagttcattagagaaaatctgaaaaatgtaaaaaatcagaaaggaaaagtcactcctcaacccatcgcatgaagacgccctcttccgctggccttctccctgggaccctcaacaagccagagcctgagggtcctctaagcactggccccgcacggcccctccccggcgagaccctgagggagcccaggctttctctgatgggccctttgctttggactcagtgcttgaaggagaggaaatgcaaaggatggggccaacggccacacacctggtcaaacttcttctgcttcttctccaggttgcacgcgctctggcgctggtggtccaggtccaccagcaggtcgtccagctcctgctgcagccgcgtcttggtcttctccagcttgtcgtaggcggccaccttctcctcgtgccgctggctcaggccctccaggtccttctggagcttcctcttcacctcctcagcagtttccaggcaccccacactgtcctccatcttctttttcatgtcggccacctgggcaggagcaaggagtaagcagatgcccgagatggcacctgctcaggtggcacacccgtccctggggcagctgggagcctgcctgccacaccgtggaaggggcaccagggatctgcccagttatgaaaccgcctcccccagtcacttccctctccacaggggcgagacaaatggagcttctgcaaaggggcatctgtctactgtgtgaagcccgggggaggctgacccccaggcccgctgtgggggctcccagcccacatccacaccaagcctcttgctctacggagactgctcccagagagcagggccagtgccctgtagggtgtccacggggtccccatcacccagccccatccttgcacttggagataaacccacaatcaggcacgctcgcgggctactcctaccctgactgtggaatggactcccagcccatcccgaggtggttcaggccttctggcctggcacatggaggcccaagataggatctagagcaggggctctgaaaccatattaggctacggaccccttcgcagtctagagaggccaagggactccttctcatgacaatgttgtaacaggcatgaaataaacatgggatcagcagggcaaccagtacagaaaaatgcagttgtcacacattctaaaaaaccatggctcaggaagccacgtgctgctagatagcacatcagataacaaacagcgcaggcctgggacccatgaggccaaggagctcggccacaaccctgacagggtaactggccatttctacagatgatgacggcacagggactgccaccaccatggcttgctgcctacatccataatggaagcaatgctgaatttcagctaaagactggtgaaaataaaggtgtaaaatagtgaaaatagtggtgtcccccatctaagtccacagatccctggattcctttccttgagagcactgatgtgggagagcacggttggcttcccagggggagagcagcaatgggccggcccagcgggcagggctgtcctgcagtgcccaggccagtgcccggccagcagctccccagcctgcagagtccggccggtcccccaggcctccaaacctgggcatggagggtggcgatctgcttctccaggttgtgcttggcctcctcctcctcctccagctgctcccggaaggaattcttctcgtcctccacctgcttgagcttggtgctcaggctcagcttctgccggttctcctcctgcagcagctcctactcgcgggttgagaggggtgcgggtgcttaggagggtggtgtccaaaacccaggaaccccacacccttgaggagagggaggagctggtcctgctgatttaggggatggccacgtaaagacctggagggagctgggaggacgcagagacccacccacaggatgaagcagatgaaggagaggatgggcaatccgatgggctctgaagctaatgttgcgtggacacagaggcctttctggaggggtccaccttctgggaacctggcgccacccctacctgagtgtcctgcagctgggactccagcgcggagaagtccttggtgagcttgctggacttgctgtcggactggctgagaagcccggtcacgttgtccagctccacctgcaccgggcggggagacacaaaggaccatggacccacccccactgctcctgccccacctcatctcctttaggtaaagctggacctgagtcacaagctgaaccatgagggtctgaggagccagtttgagaagagagagagacagagagcacacatgcacctggggacctgggccacaactgctgctagggcccactgcccgcgccagggtcctggcggaggcctcacctgcagcttggtgaccttgtcggccagctctgtgcgcacgcgctctccctcgttgaacttgacctgcagctcctgcagctgcgcctccactttcttgcgcttgtgctccgagtcccctttgccctgcagcagcaccttcacctcgttggccagctccccccgctcgttctccagagtctgctttgccttctcgaggtttgctttcacctagcagggaagaaagcaaagacgtgagtgggggcctcctgacacaaggctggctggtctatcatcactggaccctagatccagacatcgctgcttctgcagccctgacgacggtgtgcctgcgtcctggactcagacggctcgggcctcatctgtcctgtcctcttctctcttagctggtgggtgacacttggttcctgtcttcactgcttaggacatctcacagcttccccatctctaaaataatacctgcccagccttctgccctgggtagaggccaggttctagggcatggcattggtgttgcagatgttagcaatatttgtaacgcaataaggggaactataattgtttgcagttagacttccaataaagcctgtctgaagtctgatgttcaaagtaacgatgtaatgttttcaccctcaaataatcacgagacagacataccataatcctcccttatgaacagggaaactgaggcacgagtcacaaagccccttagaaggggagcctggcctcagaaccaggcagttgggtagaaccctgcaactgctctgcaggactggtttggattctgtgggcccagcacggggaaccctgccctccccctgcggtctcagggaggctccgcacccgcttcgtctgctccagctgctccgccagctcctccacggcctgtgagtgcttctgcctcatctcctggatctgggcctcgtgggtcttggcctcctcctccagggtcttcttcaggatgttcacctcctgctcacgttttgacctggacagagaaatcccctcagagtggaggccggggatgctggagcgaggctgtccctggggctcttccctgaccaaagagaggcctggccagggcacaggcactccaggcagcttttctacccaccggcccctcctagccatctatcccatagcccaggctcaaatacgccctgtgagagcttctgtagcctttcagctttaaagcccagccttgcctcacccccaactttgagccaggtccttcaacagactttctactctgtagagagaaaccgctgaggaaccagcagcttccatgcctgctggtgcctaagagggccacggtgtgtgtgtgtgtgtgtgtgcagaggcccggggtccatgtctccaagccaaggcccccctggctgccctccccatcccgagggacttggtcccagggcacacctgagctcctgctgggcagctgtggaatccagcgtgtcctccaactctgttttcagagcctctagctcttccccaaggtcccgtttctgcttctcagctttattcctggaagcacgctcagactccaggtcttcctggagttcagagatctgagattccagctcccggatcttcttgagggccatgttcttctgggcagcttcctcttccactctgccaaagcgaccagcaacatcagtataaggagagtttcacctccaaggagcagagtttgcaggacaggcctgagagagctgcagcagccaaagctgcctcctgtggtcacaatcatggcacttaggatggctctcagcagaaacaacatctgagacaaccagattgaagggcaacacccctctgagaagcagaaaacctcatagaggaatcgtttcaatttccaaagtaagattcactgcttcaaatatttttaaaagtcaaatgatgtgttaaatgggaagaaaaggaaataaaacgctacaccacaggacaactgcaactcagtaaaaatacgaatgtgctacggactttagatggttatgacaggtcaacgtaggttcaccaattagaacagacacagcactgtggtaggggatgttgactgcaggggaggcggtgcgtgagtggggcagtggatagatggagaatcttctgctgactcttctgtgaatctaaaactactctaaaaaataaagtctctttcttttttttttaaacagagtctcgctctgtcacctaggctggagtgcaatggcacgatcttggctgactgcaacctctgcctcctgggttcaagtgattctcctgcctcagcctcctgagtaggtgagattacagtcgtgtgccaccacactggcgaattttttatatttttggtagggatgggggtttcaccatgttggccaggctggtctcgaactcctgacctcaagtgatccacccggcttggcctcccaaagtgctgggatcacagacgtgagccaacgtgcctggtcaagtcttttttttttttttttttttttttaagtgtgcctatagcaagaaattaggaaaggactattgtaggtgggtgatagagctgtggatgactttttttcaaattataaacaaacaaaagacaaatgaggcccctcaccatgccctgagtgcacaagaactgttttgctatgaaataaatggctcttttaagacaacagtggaaagaatgctcacagctcactagtgccgagaactagggccagcagcaagcaggaagggctggcccaggccacctggcctcaggcgggcaggcggggtcctcacctggccagggcggcctggagctcctcctctttcttggccagctgcatcttgagctccgcgatctgggcctggagctcggcgatctggtcgctgaggtctgtggagtctccctccagcttccggcgggtcttctccagctcctgtcgctgcttctcctccctgcggaggcgctctgcaatgcagggggagcccacatagccctcagtgccatgggttctgtctccgtgtcaattacttatacaaaatactgagcactcgttatgaaacgtgtgtcaggcttaaagcatcacaaacacacagacactcgcacccaactcctggatgcaggaagaggacatcactgcaaactgctagcccctggcatgtctctctccaactcaccccttgtccttccctgccaggaattaagtactctcctaaagctggtgtttgtaattcccttggttcccttgaaggctgtaccatgtctgtatctctaaaaaacatgttcaattgtgtgtgaatctgaacttatataatggaactgccttgtgtgaattccacagttggaatcgcacggtcagggctctatgtctagctttataactctgtgatgtcacttgggaaagctactttctatacctcatctgaataataagcaaaaggagacagcctacttcattaggatgctgtgaggcgccaatgagttactatcttaaaaagcacctagaacagtgcctgcctcgtgatggttattccctgccgtgcctttgccaccccatcacgtgatcttgagatgtagcccgtgaagtttcgctggaatagatgtgtaaggacatttgtctaggattccattatgagaatacaccacaacttacttatgtacccgtcctgcagctggcgggcatgcggctgtgttcatcgcacgctctgatcaacgctgctgcaagcatcctgctcactctcagtgcacacggctgagtgacggatggaacggccaggtcaccggcatgctaagtttcaacctcactaggactgccggatcgttctctaacgccgtctaccagtttgcagtcccagcagcagcatatgtgtgctctgacagctccgtgtctatgttagcccttattagtgtcaacctttcatgtctgtccatctggtgggtgcaaggcaacccctagacctcctagatgaccaagtcttccgggctcctcccaggtgagggagggtgtctgtgagggaagagatctctctgtgtccggacctctcttctgctggacctgactcacctcatcccctgcagatgtgagggggccggacaagactgtgaaactaagctggggataatcctcccggtggtcaggttttggtctccctcccctgggtatgagctcagagttcccagagtagtcggggttcccctgttcccccagctgtccactcctctcaaggggcagggctgggggtcctcagacagccacggacctgtgcttctaccccagcaccccctccctgccacagatcccgagggcacacagagacaaggcaggatttgtcaccctgccccaagtcaagcaatgaacttccgcagtattcgtctaggactttacggtacatatgtgttcacatgtatttaatgaaattctcacagacaccctagcactgtgtcccctttttaggtaaaactaaagctcatggagcttaagtcatagctgcaagatgagccagctagtcagtgacagagctagtgagtcctgtgggtcaaacccggagcctcctaggaagtctcagaagcttccaaaacccacggcacacaacagagcaatgccaaagctctctaaacacgcttcatgcagtgggggcatctagccacagagcaacaggggcctggaggctcaggttcccgcaggcaccagacacggctcccctcgacctggtgacctcaggtctaaagggcagcagccagtgctgtagtgtgacccaggctcacccgtgagctgagaaggcctcggtgttccggtcagacaggccggcccctgaccgccagcccttgcccgccagcccctgcccatcacctcctgctcgtcaccccctcaccttccaagtcagtgatcattgcctcatgcttgttcttgagcttggcgaggctcttagatttctcctcctcttctgtgaggttggtggtgaactcagctattctgtcttccagcagtttcttttcctggggagaggggagtaggctggcatttagtgttggttgagcacagaacacttgctagcctcaaagcatgactcgcccggaaatctggggctgaatggagagggctttagacgcttgatcaagttcattaggattttcctagatcaaaggataattttgaaaggtcacgagctcccctgaaacagcgaggtacgcttccttagaaccaaaaaatgtgggtgcccaagcccttccccttcccctgtgggcttgggtgagaaaggattccaggtgacagctagtgtcagcagggacagatggctccactccttcaagaggctgccacacggcgctcacctgcgccaccaggccaccttctccgtgcccctctctcacctgccaggtgggccacggcccctccccctcttcagccccgcggtgccccgggctgctctccttgctttctgttctgtgtggcccctgcaacacccctgcccagcggccacagctcggcacaagcacctgagtcccctcatcccagtcccgggtgggcgtcctgccacctcagcctccccagcctttggggctcccatgttctgaggaggcccgaaaggtggggaggctgccttctcctgccttctcctctaactggttccccggctgctatctgctccctgggcagacaccgacagggacccaactcattctcaagaggaatagctgccgcccagggacagtggaggaagagtaccccgtatctcaacacagagccaccaaggtgtccccaaccccacagtgaccaacacttgcaatgctgcacagatggccacctttacacaggctcgggtctcacggctggcaaagaagagctttccagaggggaaaggacaaacccttccccagggcccctttgcttatgaggaaatccctcaactaaggcccatgggacctccagggagcacttgcagttaagcagaagccctcatgctgcaggcagaagagacaggaagcagcagcagcggggagccaggccctgcaagggtgaccacactctcccatccacggcgcccctggagcagcggcaggcgacagccacgggcctcaccttggccagcttgcagttctggtcctccaggatgatctgctcctcctccagctttttcagcttcgcctcggtggtcaccttctccagctgcagcttctgccgggcgctctcctcctcctccagctgctcctcaagctcctgccgggggccagagacacggtaaggacagcaggcccagaggcatggccaaggtgaaggcagcaaggtccgaaggccagatccaaacgccaaggagaaaatagcaaggtctgtgagcccagggccatggctgaggtggggacggcaaggtccgccagcccagggccacagccgaggcagggcccaagccccatttgtaggattccagatttcaaactgggacacagggccagaacatcggtgcaatgttctgaagggtttcctgcagcaagctcccacccatgaaacaggcaggacgcagaggtgctggccctgtgccccttcggctagccagggccagggctaatggcagggaaatcaaattggccttgatgctggcccaggcagtgctcatggagatctcagatgcacatgtcacaaactaccagcccaaagggaacacctctcactgagagccccaagcagattgcgtgaggagcagcctccttggaccctaattccatgttctcccagctcctggttcctgctcctccgccccgccctgcccctccggcgccacccctccccgggtgcagcgggcaggaacctggatgttctgctgcatcttcttcttctccgcctgcaggtgctggcagcgctcctcctcctcctccaccctggcctctaggtcatggcagatctcttctaattcctgcttcttggcggtcaggcgggcccggagctcctcagcctcggcacacagctcggtttctgcctggagctgctcctgcagctgcaatttctctgccatgagctgcaaacaacaagtggaaaacacaagctcctcgcaacaccctcaagccactccatcctcaaggacggacgccatggctcgggatcccagagggaaaggaacatgcagacaaaagtagctttcatctggagagctctgaagcttccaggtaccttccagacatcgtgtccttgatttttcactaccccatgagctccagagcaaggtcccaggaaatgggctcaagtcatgtggtagagctgaggtttgaacccaacacttgtgaacgttccactctattaagtggcctccctacatcacttaacacccaatggggtctgcagagagactggtcactgtttacagtaataggaaactcagttgtagaaaactcctatagtaatagaaacttccagcatgccgtgcctaccgatggccagcaggtggcagcaccaggcaggtcgtgcgacctggactgagcctgcactgacacccacctgagactgcagcgtctccatctccgtgagcctgttctccgcagccagctgcttctctctgaccttcaccagctcctcctccttggccatcatctcctcctcctgccggctcacctgcagcagcggcttgacctgggagaggagatagaggtagagacatgctcggctggaagatgcccgcctctgccaacaggtgtgaggcctctccctcacctctggaaacatgaaagtgaggggcaagaagacacgctgtggtgggggctgcaagcaggcacatccttcctggcgctctgtaccacgggcttctgacccgctaactacattccagggaaactatccctgcgtgtgcgtgaagatgttcacctcggcattgtttatcacagcaagaaaatgaggaaggacccatctctgaaaaagtacccagataatgatgtgttccctagggaacagcacactacctctaaaaaaacgatgcttatgaaggaatcataaatggaacgtacgaactacaactgtttatatgagtcaaactcagctatggaagaatgtatactgtttacatagctgaggttttataggcagtgagaaaaagagcgagaaattaaacactaaaatagctgctgctgttggtttaggctaagggtttatgtgtgaatttttatttaattctttaggctttttgtgagttggtttttcgccattaccataaattatgtattatacacaaaagcagcccggacaagtttaaaaataaagagattttttttttaaaggccaggaaggtcagcctgggcaagatagtgagaccttgtctctactaaaaatcaaaaagggccgggcacagtggctcatgcctgtaattccagcactttgggaggctgaggtaggaggattgctggagcccaagagtttgtgaccaacctgggcgacatggtgagaccacacctctacaaaaaatacaaacaattagccaggtatgtatggtggtgtgcacccgtagtcccagctactcaggaggcccttctagcacgcaccttggtgaagagccgccaccactgccagttccgcagcttcaggtaggcagcgcagttccgctggaggaccttcatggcggtaagctgctgctgccgcttggcaaatgctctgtgtggtgaggaacatggtcagcgcggagcagtggacagcagacccgacctaacagtcctggtcttgtcctcaagcttttctgggggtctacccttgcctggggcacctcaagaaagaaattcagggaaggggtctggccttggggttgagataagtttctcccacttacaggctgtgtgactccatgaggcactaatcttacagtcggtgaaggacctaggtcaccagactacccctccactgaggtgcccatgggggtgaaggcacgtgtgaagtaaccacagatcctactcagtgtggggactgagcgtgacccttggtgattaagctgactggccctgggtgactctggacttcagcttcccacccttcgtgctgttccctatctgagcttttgtttggtgggagaacgtcagaagctgatgtactgtgaaggtgggctgcaggtgtcagctggagggcttttggataaacaagcctccatctgtgcaaatgctcaagcttcgtctcccagagctcggcgctcctgctaggaccccatccccgagcacaaggggacgagtgtgcagtgcccacagccgctgtcctgcagcaggggagccgtcattccccagggagtcaaagatgagtctggactcgaggatggcctgctcccctggaatcacagggttctttagggacaggcaggctctgggtgctgtccccacaagggtcacacggtaaggagtcctggtaagcaggatccttcaggcaggcaaatccaagcagagtcagcctcttcccacccatcactctaaaccccaatcagaaatgccagattcagccaggagcagtggctcatgcctgtaatcccagcactttgggaggctgaggtgggcggatcacttgaggtcaggagttcgagaccagcctgggcaacaatgacgaaaccccgtctctactaaaaatacaaaaattagctgggcgtggtggcgtgcacctgtaacctcagctactaagtgaggctgaggcaggagaatcacttgaacgtgggaggtggaggttgcagtgagccgagaacgcaccacagcactccagcctgggcgacagagtgagactccgtctcaaaaaaaaaaaaaaaaaaagaaaaaaaaaagaactgcccgattctactcctcaaaggtagaaatccaggaacaggggtaggaagagccacctgggcctccctgacaggcatgtgactggctgcagcggggtggcctgctaagtgccctttggcaacagaagggcgtggcaaggcctggcatgcggggcaggagtatctcccgggactcacttcctggccaggtagcccctgcagcaggcctggaaccctatgatgacgtcggtgatcttcaggtctcgctcctcctccaggtgggccagcacaccggcacggaagaagactttgctctggccaatgcggtacagattgctgtcgagctccagggcttttatctaggtgggaggagcaggccgtttacctggccagcaactggccacagctccatgaaagggtggcccaggcacagctggaggtgtgcccttcacccttcttctcactggctgacgagcatctggagagcagaaagccatctcctctccctccttcttcctgttccctatctccccgtcaccgaacgcaggctgtgcacacagtaggtgttgaatttttccttctcttttcctcccaccaactccctactctgcagccaaagctttctgattctttagaaagaacgtgaagtaaaacaaggccaaaggtagcagctgctaacctggacacgccagaaacaacaggatgctgggaaggggaaaaaaggagcagggtgggattcagccctggcttggcactgagtcaccgcagggctttcaatcaaccggaactcagagcatgcgcacagcccgtccagcactgcgctagggctgggagtggggagggagggaggagaagcccaggtcacggagcaccaggcctgctgccctggctgtgagctgccctgctcaccacactggatgtggagtcaggcccgtgagcaagaaagcaggagaatgtcccccaaaccaaagaggccatcatcttacatcagagcccggccatggctacagttcttgtctcctccacacaaccctggtgccaaacaccatccctggctatctgaggcctaggggctactgcaaagggcgcccggcagagtcagacgcggagcatcagaagggacacagcctgggcatccaccgaccactgatatagcaaggtgggccctggccacgtgggcactccccagacaaggggctgcccatccagagaggcagggacagcagctcaactcaccatgagcacgcacgcctgcttcccgtccatgaaacccttgggaatggagtttggagtcaggatctcatatctgaggaaggaaagagaagcctggtcattttacccattgcctcgattccacatgcctggaatataggcgagagattaacatcatttctacaatgcaacagacacagaattctttacacaaactctcctaaggaaagaagacacaggcaaatcccaccccactcttttcttcggctgaatgagacaaggaagccttggtgttttccggaaagtgaatggaaactcgtgtaggaccgtttcaatcactcaagggcgtgcttcaggttggactaagtgctaattgcctgagatcctcatctgtcacccagggacagccatgttcacacagcttccctgggacgctgcagggagctgctaataaacagagatggcccaagaaataaagggctgcgtcccgacagcaactgacactcagcacagtcattagagaaacaggaaggtgtcgccgtcttcgcacacagcaacgcacggccgtgtttcatttccacaaagttcctgtaatatcctaggtctctggctgattcttttacatttcttttcatagctcctctaactgtagcaaatagcaccagggccggcagttactaggagcaaaagtcaacaggatgatgatgacctgcatttcggtattaaaatggggaagtctcctttcctgcaaagggtggaaaagagaaggaggtggggaagagctggccagactcagttctacatggatggaggacgtcgctccctcacgacaggatcctgccagggagcagcagcccacctctgggactcactgcacgcacagcagggcccaggagaagcgggctccgggccctggctcacctctgccgaaactcctggaagaccaccctgttggggaagccctggcggcagatacggatgccctcgagaacaccgttgcagcgcagctggtccagcacgagatgcgggtccagcttgccggcctggagaagaaaacacatgcatgcggtctcacttccgtgcctagaacagtcggagaatagtcagggaacccctatgaacctgacagggcaagagcctaagggagggggtcgctacagcccacaggtttggacaatgaagtcaaaggatccaggtctgggaggggccaatgccaccaagaggaagtgcaggctgtgaatgtagcgtatctcctaagcgagccaaggcccaccctgcagagaaacgactgaaggctctgtgcatgctggggggctggaggggtgcttttgctggggagacagacaagggctgagcaccccacaccacagtgccctgcccgggccaccccaccaggcagccgcaccttcttctcgtggttggggatgatgcagcggacaaagttggggttcgtgttcctcagcgtagccatcagcttggccagctgctccttgtaaagctgccccacagtgcggaacatgcccttccgcgtcttgaaggccccgggcagtgcggtctccgacatgccggccacctggtccaggccgatgatgcggtccactgtggagaccacagagaacacgtgagtgcccacacagttgcagctgggtggtgggggagcacgtaggagagagagacaggcacacgtcggacaggaaaagaggagacagaatgaaacaacaggaccctttccaattggagcctacactgggtgctaaggtcatccccaaacacagcgggaagccaagggggatgcaaaggcactgggcttgtctcttggggagccatgcatctgccatggccacctcaccttcctgtcacctatcttcagccactctcgaagctcttatttccaaaaagactcaatgaagctagtcatgtattttggaatagtgagaattctactagcctggctctaacgaggggtgtgaaaacctggcttacggaatcctgctgtcctatggtcacagttagaaaaaaaaaaaatcagtatcttgaattctcactgaccctgtcataagagcactcggctgggagtcaggaggcagagcttggggccaccctgtcactgtctgcagaaccttgcagggtcccctctatatctacgcagacatctcaggaagggagagctccaaagaactgctcttgattataaatactccaaagtttagggatctcttcacgtacttgtatttcattttgtctcctggtgcacgggtctttctcatgtaaaccgaccctcaagggaagcagcccctagcactggaactcacacccagcagcaattaaaccaattgcatcctccaaggtaaaaaacaaacaaacaagccaaaccaaagtggccagcgatttgagatcagtttaagcaagagctaatgttaaatgtgaagccttctattactggatataaaagtgaagaatactgacgaagcccgtttcgtattccttcacggccagattactattatttacttgaagacagcaaaaaggatgcttgcttaagacagaagccaggagtgtggatggagcctacaaaccagtcaattaaaatgggaggtggctgggcatggtggctcgcgcctgtaatcccagcactttgggaggctgaggcgggtggatcacctgaagtcaggagttcgagaccagccaggctaacatggtgaaaccccatctctactaaaaatacaaaagttagctgggcgtggtggcgggtgcctgtaatcctagctacttgggaggctgaggcaggagaatcacttgaacccaggaggcggaggttgcagtgagccgagattgcaccatggcactccagcctgggtgacaagaacaaaactctgtctcaaaaaaaaaaaaaaagggagtcatctttgaccttatgtacccaccacagggtcaatattcctggctaccacaggtttcctgggcgtggtaacttgcaaaagccactcaggttgtccagagaaaggttaatgtggcctcatcataactggcccttttagctgagtgtgtcctggccccacccccatggagcagaccttgccgagcaactgttgaatgaacacacagatgccacttcagctttcaggtgcacagacacagcagtgtgcatacctgaacctcatgctaagacactcgcagccattcaagcagtttaagacgctgtctttaggcatgaagctctaaggaggatacaaatttttaaacaatttttgctgttttaagatttttttttttttttgaggcagggtctcaccctgtcacccaggctggagtacagtggtgcaatcacagctcactgcagccttgacctgtgctcaagtgatcctcccgcctcagcctcctgagcagctgggactacaggcatgcaccatcacacccagctgatttttttttttttaatttttttgtagagatgagggtctccctatgttgcccagaatggtctcaaactcctggcctcaagcaatcctcccgcctcagcctcccagattgctgggattacagtgttttaagatttgaatgtgacgtctccaaattccagacacagcccctcatttgcccagtttgctactacaggccggcgataggcacagtgcggggaacctgcccagaagcccaggggcagatcagggaacgggggtgtaagcaggcaggaaaagccaaggcaagggggggcgcgagaaaacctaggcagaagcatttcttgcacagctttggacgcaccacacacacaagagacaccactcgggcggccagtcacctggttctaggtggagaataggaaagcgatgatagaaataggctctctgagtgctctgcatctctgcaacagagaggttaaagcaaaacccaggcaaaggaaaaggagaaaccaacagaaagaattaaaaagaaccactcaaagcaaccagcctaccaaggagtagaggcgggaatgcaacatggcgcggggctgggaccctgggcttcgaggctcggggctgcccttgactttcccacacacggaaagcgctccgcccaggaggacccggccacggtgtgtgcgcaaggcagtggcctcctgtttcggtccgaggagccctctctcatgggagctacagagggcagagaccacctggcctatgtcagggggcacatgtgtaccccttgtttggcagctcggcccactgtggaggtgggaagatgaccagccgcagccaagaggaggcagggggcgaagggcaaagggcgtaccatccttccacagctccgagacaaacttgtcagaggactggtggagcagtgtggcgatgttgtcattcaggggatccatgttcttcatcagccactcgtcagctttgtaatccacctggcggggtcagagaggcaggagtcacaagctgcgctggggacatgtgtgctcacagggtctccggagcacaggctaaccccatgcatggaaaagtcagaaaacgtgaagaccctttgatccagcatttccacccctaagaaggaagtggtgaggataaggggagcgaggcatcaagacgttctctgcggcgtctcgtgcagagccaaagcctcaaagcaaggcatggccaacaacgggagcctggctctagacatggcatggtggccacacagtaccgtgctgggtttcagcttttttaaaatttttaggtaatatgaacaaagaaaaacaatcctggaaggacaacaaaatgttactatttctttttagtcataagacaagtaatttttgttttttctttgtctttttagaatgttcacattttctctgagtatgtgtcagtttcatctttttggaaatatattctgtttttaaatatatttttttaattgggcagcctcctaaactagagggttcagagagactcccagaaatagattccttttttctcattttaaatagagataggggctgggtgcggtggctcatgcctgtaatcccagcactttgggaggccaaggcgggtggatcacctgaggtcaggagttcgagaccagcctggccaacatggcaaaaccccatctctattaaaaatacaaaaattagccgggcgtggtggcacgtgcctgtaatcccagctacagggctgtaatctcagcccctaggggggctgaggcaggaggatcgcttgaacctgggagacggaggttgcagtgagccgagatcgtgccactgtactctagcctgggcaacagaacaagactccgtctcaaaaaaaaaaaaaaaagatagagatagggtctcactatgttgcccaagctggtctcaaacgtctgggctcaaactgtcttcttgccttggcctccccaagtgttgggattacaggcatgagcccctgtgctctgctaaaatatatacttaacagaacaagtaatacagcatgacatcttcattgcaaaaggtcccagaacaatacccagagagcatcagggacctaggcctccctcttcccaacacaaactgcagcccagaggtgctcccctcagtatgcaagcgaatgcacgctgctgcatcccaggggtgctcccctcagcatgcaggcgaatgcatgttgctgtttatcatgaggtaggtgatgccagtttcctttccccaggctcagaccctcccacccaggccaacatccttgtccttttagcggccacagcacagcccacggaaagacgcaccacagttgatgccatcgtgcaggccccttggtgggctttagggtattcctaattattcagcattacaaataatcccacagcaaaagccttcctggaagcttctgcactgatgagcgtgtgcgtttcccaaaggtgagagtggagaaaggaggctcgggaaacattccttggttaatggtgtaaatcgcttttttggctttattatttttttcatgggtagtttaagacagttgcttccgcagccccaggaaccagccaagctaaatagaagaggccggcacaggtgtgctagaaccgggcctggactccttgtggcttgggaacagacctgtgaaagctcccacatctcctcgccagtcatcaccaactagtcaccaccaacaaggagatggcgcagcccctgcctaatcacagcaattaactgttagggtctttgtgcaggaagcacacgatatgctgagaaaaaccagcttttgtctaagcatgcacctctatggactaagttgggtctaagccccagtcacatgcagactgggaagatgtctgctaggtaagtgttgagggcaggtccaccactgactgactgtggcagacttggcaacagcagctgtcacccacagcagtggcaattccccgcacctccccccccgaaactaggacatgtttggcgatgtctggagacattttgggttgtcacaactaaggacggtgctcctaactctagtgggtagcagccagggatgctggtaaacatcctagcatgcacaggagggtcccacaacaaagaatgacccagcccgcaataccaggaatgccgaggttgaggagccctgccccggagcactgattcatgccacatgttgggcctcaagagcttgtttaatccacataatcctgtatggtgggtggtcattctcattttccagatgaggaaaccaaggatcagagaggttaagtaactgacccgaagtcaaacagcttatgagtggcagagctctattcaaactctgagcacatgcctttagccaaagctctgcacctggcagacaggcccaacgataatgcatgatgacaaccagcctgggcaccgcggtggagtgccgcaggcttctaacagcatggagcaggtgaaggggctctgtaagctgtgtaaatgatgatgctgtcaccggccacattactgggtgagtcattgtgcaagaaccgtactcaggtcacacccctgcgtccccagcagctgcccggctcctggtcctagagagcctcgactccacctctcctgtgaagatctggccagcacctccccgtgagcgctcctcaccttgccggcatagtggataatgcagaaatcagctttgtccttcagctgcttgggcttctggaacttggggtgggtgccctgctcctgcatcaccttctccacgaagctcttgtcggtggctttggggaaccagcactcctcgtccagcagggccagaatgcccggggggcctgcctggaggaagcgcagcatcagcacaggtgagtgcaccctgggaggggcaccccacccttcaagaagccaaagcccggacatcagaatcccctgaatcccacagacggtgggcgacacactccccaggagaagcaaagcactgttgaagatttctagcttctaaagaaacctctggggcccaggctgcggctgacacctttacccaaggatccatcgcggtggttctccagcattagtgaaaccctcagtgggtctgatgaaaagtgcacatccgctgacccgcggggccagagtctgacttcacagtgcactggggtctgcccaggaggctgccctcaacaagtaccctgtgatcctgccacgggagatgccaacccacatgctttgcgtctgcatgtctatgatgagatgggatatgtaggaggagccccttgaggaagatagtcccagggacccagcagccttctgcacactgagtttacaagacaagaaagcaggtttggacactgcagagaggctgacaaaacttgaagcccagtgggttcctattagttggaaaattcaactgattaaagaaaaaagctcattacaaaagtaaatttttggccaggcgcggtggctcacgcctgtaatcccagcactttgggaggccgaggcgggcggatcacctaaggtcaggagctcgagaccagcctggccaacgtggtgaaactccgtctctactaataatacaaaaataagcctgtaatcccagccactcaggaggctgaggcaggagaatcgcttcaaacagggaggcaaaggttgcagtgagccgagagcacgccattgcactccagcctgggcgacaagaacaaaaatctgtctcaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggctgaggcaggagaatggcatgaacccggaaggcggagcttgcagtgagccaagatcaggccactgcactccagcctgggcgacagagcgagactccgtctcaaaaaaaaaaaaaaaaaaaaaaagaagaaaacccagacacaggaacagctcaggcttcattacagatcataccctcaacaagcctaaaacacaaacaggcgacccaacctctacctggcaagaggtttaagtatgaactcattggaaagggttcctcttttccatcttcacacagctaatgctggcgataaaagcactgctgcttgctggttttatgggggggatgagctgagctttggtacgtgtacacctgggcagagcactcaatgcccagggtctgcactgttccatgctacagtgaaagcagcccgcgatagggccttactacatccatgcatggctgtttctttaagacaaagaaatgcttatcgagcccagccttcaggaggatgctgggtggtcttctgggactgaaaacaggatgctagggcccccgccacatatgcacctggtccggcagctgggaaaagcccagcccacagctgcagcccagagcatctcctctaatggaggcacccacccaggcctcccaggcactggatctcagccttggggcttcatcctccgggtggcaccaaaaggaaggggagttaagacacctccacaaccaacacagagctgaggtgaggagcgggtgccccggaagggaaaagccagaggcaggtgtgaggtcaaagcaagcctggtactcactggcttctcaatgaggtcgatgcagggctgcaggtcgaggccaaagtcgatgaagttccactcgatgccctcgcgctggtactcctcctgctccaggatgaacatggtgtggttgaagagctgctgcagcttctcattggtgtaattgatgcacagctgctcaaacgagttcagctgcaaggagagaaaacaatgtcagagagacgccaaccctgcactaaagaggcccagacaccccttgagaaggagggtggggcagggatacaggaagggcctccttgggcacctccatgccgctgcctttagagcccggatgctcctggccttccctttatccacccagcagtgggcaacatttactctttggagccagtgaccgcgggcagtctggtaaagccttttcagaatagtgctttaaattgcatccaatagattacaaagaaagtagttattttgaaatataatcatcaaaatattgtgatcgagtaatacattgttttttttttttattttttattttttgagacagagtctcattctgtcacccaggctggagtacaatggcgcaatctcagctcactgcagcctccgcttcctgggctcaagtgatcctcccagcttagcctccctagtagctgggaccccaggcacacactatggtacatggctaatattggtattttttgtagaaatggggtttcaccatgctgctcaggctggtcttgaacccctgagctcaagcaattcttctgcctcaacctctcgaagtgctgggactacaggtgtgagccactgcaccaggcccttctatttttttattgaagagatggggccttgctttgttgcccaggctggtctcaaactcctgacttcaaatgattctcttgcctcagccttccaaagtgctgggattacaggagtgagccaccgcacccggcctctgtgcttccttattaacaagaactagccatgggcttaataacttccaaaattttgaggtagcgatgcataaatgacactaccagatctctgcaacaaccggaatgtaacacgaaaacatctgatttctattggtgacagatcacaagtactgctaatacaactgtggtttgtatagtttgttcagttcgcaactggaaaaaatacatgatttcaatgagaggttagtaaaaaataaagatgtaattttctcatcccagctcatggctcctctcaaacctcccgtggactccaggttaagaacctctaatctactgtaagtatcggtttccctactagacctcaaagttgtcatgggcaagggagatgtcttatcccgatgctcagggaatatttgctggaagaataaacaggaagcacctgcccaggaagcctccaagaatgtgacctaaaaggtcccatcctcccagcctggacaacatggcaaaaccccatccgtacaaaaaatacaaaaattagccaggtgtcatgccacatgcctgtagtaccagctactcgggaagctgaggtgggagaatggcttatgcccgggaggtcgaagctgcagtgagccatgttcacaccactgcactccagcctgggtgacagagcaagaccctgcctcaaaaaaaaaataacaaacaaacaaaaggtctcattttctccagcatttctggttgaaaatgagcccttctgtttagcttaaaacacatctaactgagcctgggccacacctgaggccccatctctacaaaaaatttaaaaattagctgggagtggtggtgcgtgcctatagttccagctactaagggggctgaggtgcgaggatcagttaagcccaggaggcaaaggctgcagtgagctatgactgcacctctgtactccagcctgagtgacaaagcgagaccctgactttttttttttttttttttgagacagagtttcacacttgttgcccaggctggagtgcaatggcgtgatctcggctcactgcaacctctgcctcccgggttcaagcaattctcctgcctcagcctcctgagtagctgggattacaggcatgcgccaccacgcccggctaatgtatttttagtagagacggggtttctccatgttggtcaggctggtctcaaactcctgacctcaagcaatctgccggccttggcctcccaaagtgctgggattacaggcatgagctaccgtgcccagccgagaccctatcttttaaaaaagaaaaaaaaaaaaacaaccccacacccaaccaaagtcttcatgcaaaggagatggccaactcagatcgatgcaggaccatgagaagcagggttcttaaccaaggataaggcaaccaacaggccaaggaggcagcagggtgggtaatgaagggcaaggctcacatcaaagatctcgaagccggcaatgtccaggatcccgatgaaggaggcgccctgcctcttggtcttgtccagagccttgttgatgcgcagcaccagccagcggaacatccgctcataggtcgccttggccaaggcctcgatggcaaagtcagcctgcggggcacacccggggagcgtggtgtcagatacaaaggatctgaaaaccctcataccctatgccccagtaatttcacttttagagtcctccccctagaggaacagccctaagtatgtgggggaaaaaaaaaaatcttcgtacacaaatatgttcactgtggtgttatttaaaatgatgaaaagtagaaacaacctaatatctaacaatatggggacaataaacttagatcttttgaaataaaatgaggacacactaaaggatttacagaaaaagtgatgcttcaaaataaggcagtggtctacggccgtaccaccctaaatgcacccgatctcatcaaaataaggcagcagtctacggccataccaccctaaacgcgcccaatctcatcaaaataaggcagcagtctacggccataccaccctaaacgcgcccgatctcatcaaaataaggcagtgggcagaggggcagggggagataagacaaacgatgagccaagactcgccgtgagttagtaactgctgaagccgcctacgtgatgggcacgtggggctctttacactctcccctcttctttgttttgcacatttgcaaagctctgtaattaaaagccagaaggagaactaagtttaattcttttttttttttaagtcttgtaggaaagagctgcccaatgatattcatcactgggaattgttttccttctctcgatttttctgtattaagagtcatgtagtatttttgtaatagaaaatggaggtttctccttaatggtcagggaaacgaacaggtggcaggaataatacgcgatgtcttttgaaaacaacagtcttgtctttcatgcaatgcttctgcacagaaacagccgtgagctgtcagtgtacagtgaatgggagaaagactaacaaaatgagcttccaagtatttttgagagatgggtttggcaccctaaaaacccccatggccagcaccataaaagaaactagaaaccccggagagaggcagaaagcggtccgcactgggcgggacctccactccaggggcaggcaggcacatcagtctggcaggaaggagcaagcgctgctgctcgtctctcagcacacgtggcaagcccaaggcagcaggtggtagagaaacagccgcttggcacaggctcgaggatggcgggagccgccaccctggcaccagaaggagttcagctacagtggcatcaagttcctgcttttataccagacaggacatgcctatatccttgatgaccaatcagccaaaataccatctcaatgtaaagaggcacaatgcagtctcaggatggcacttcctgggcgtgaagccttgagtgtgccatgaagcttctccagtgctctagatggcgttatgccacctctctccgggttgctgtgaggactgcatcatggaatcatgtgaaagtgcctgacacggacaccccaggatggcccacaacagcctcaactgtgctgctgcagggacattcacccaggaggcagccagctgccctggccccagaggacatacctgctctttagtctgcgccttctggacgtaatcccgtcccaccttgatgcgcggggtgaggattcctctggtgaaatcggtcacattgatacccaagagatgggacaccttttgggcagctaagatttttcagagaataagagagggacaaaaagtcctaattagacccaagagagaaagttctaattagacccaagagaataagtccctctgcttgacttgggagcagagaggaagaaagccacggggtgaatgagcaatcattaccaggacaaccgcatctgggcccttctttagcagggccacagacacctagcaccccccagactcagcagccacatacaggtcagtgggcagggcagctgtacctcccctgagccccacggggcagagaggaaggcgtcctggctggaggccacagcggcagcagtggttcctctgtccactctcagccgcactcctcagagtgtaaaagcaggtccctacccaccaatggggctgagaggagcaggccaacctggtgctggggcacggaacagcacaggatcccacaggaatgtctttttttttttttgagacggcgtcttgctcttgttgcccaggctggagtgcagtggcgcgatttcggctcactgcaacccctacctcctggcttcaagcaattctcctgcctcaacctcccaagtagctgggattacaggcgcacgccaccatgcccggctaatttttgtatttttaatagagatggggtttcacaatgttggccaggctggtctcgaactcctgacctcgtgatctgcccgcctcagcctcccaaactgctgggattacagatgtgagccaccacgcccggtcaggagtgtcttttacaatccacacacccatgcgttacatctttagagagaccctaaggagggcacattaagactgaataacttgcatggggtcatttgcagcaaccctaacaaaggggctgaatcgggtgtggcaaggacataatttcaagatctcgacatagtcacaggcaaggctcccattaaggaggagctacggcagaaatcattggtgtcctgacgaatggtttggtctcaggaatgaataagggaagccctggtccacatgatcacaagtttaagttattctgaaatgcttacttggtgagaaaaaaaagcagggtcatgtttacgtgtgttttacatctgtatagaaaataccgacagatactaacattaaaaagaatagtgtccggaatttccgcaagaccttccctcctgagcaaatccatggccaagcacctgccccattatttccagcgagaggccccgggtgttacctgtgttgtcgggcatggacgcctggtcagtgttccgctccttcttgaagacgatgttgccgagctgaagaacccctgagatgacccgcagcaggcctttgggtgcaatcagaggcagctcagaagcagacatgggtcatggtgattcccgggggtgggggccactcatctagggatcctcaagccagacaagccaagcagggacaccccccaactccctggggccacaggggcgccaggtctgcgtctaacggtgtgcggtgggcccagccaccctagagggctcaccccctcctggccgacatggcctgtccgcactgccattcatgctgggcttcaccagcacaaagcacccatctatccccagcttcttccacactccccgagacaggacgtgaatattctactttcagcaaatggcaagggctgtgcagtggacccgagtcctgggcagttaagaacatgtcctttgcaccctttctgaatgcctgtggtaccaccaggaacaaataaccttgaacctcaaatctgaggaatcattttcccatacactgaaggccttccccttcccctggcctctagcaggctccccaggcccatcggctaccctgatgccccgaggccgtgggtaccagccttcctctgccccacactcgaccataggagggccagccctgtacccatttgctcctcttctgggatgcccataatcctcatggcctccatggtctcctggaacatgtccttgtcctgctgcccggggatggtgacgtgtccattggacaggaagcggtatttgttgtacggctccaacaggagatcggctgtaaggggtggagggcaagggcgcctcagcgaggtgctgaaagtggaggctccatcagcgctgtgacctcaaaggttggagagactgggacagaccctgagccctgacgcaccctggaaaccgcagagtagccagtgacgttcagctttcctcagtgtctgagactctgacactcccgtctcctggcccaggagagcgccaggtcctgtgatttgcagctacatgtgcaacccaccctagcttttctctggcatggtcagaaacagaagaccaagtccttaggatggcgcagagaacaggagtcactctcacttctccccgttaaacccaaggccaaaagttttcatttcccaaatgatgtctacggtccaattctggcaagaggcccagagcccggcagccccggtgtcaggctgcaggccaactactcactcttcaggtgctctccagccccagacaggagataatagaagatgtggaaggtccgttcttccttggcttggcggatagcacgagatttctccaaaagatctttgcaaatattaaggagcaacacaagctggggagaaggcaagccctccactttcctcatttttttttttttggagacagagtctcgctctgtcacccaggttggagtgcagtggcatgatctcggctcactgcagcctccacctcctggattcaagcgattctcctgcctcagcctcccaagtagctgggattacaggcgcccaccaccacacccagctaatttttagtagagacagagttttgccatgttggccaggctggtcttgaactcctgacctcaggtgatccacccaccttagcttcccaaagtgttgggattacaggcgtgagccactgtgcctggccagccttccattgtcctcttattctcgtccaaaggaactgaacttcaccaggaaggaagaatggcacaaaatggcaaaacacagcaaaagcaaactacctgggttctcaccttcaaggggcatggcatgtccaagaggagctcacaccttcgagagccttgtctcattcttacaggtaatgggaacaagaacattcccacaagcaaaggctaaacggtggcacgcaggagagtggcatcccccaaacgcctacctctgggagccacactagacggctttcaacagctccatgccattcaaagcacaggttatcctgcctgtaaataaggaaagccctaagctctgtgttgggtttgcactagccgatcctgacagtcccctagctccacagagaaggtgtcaggatgggcccataaaggggaaagtgctggaatcaggaggcagcttcttctctacagaggtcatgcctcccctccggatccaggactcttatcccaacgaaccacaaggatacaagtctcaatgttggctccaacaatgtagccattgacatcaaagttgatgcgaatgaatttgccctaagtaagaaaggatagcaagagatcagaggtgcccctgacatggggagctagagagcacgggggagaccacagccccccgccccacctccggtgggcacagcttggagggagaaaacccagagacgggacccatgtaccaggccaggggccccctacgcccacaccacacgggacctcgggactcaggcgccacactgcctaaggccatgagcctgagacaagctgatcccacacccaggttcctccgcagagggggaaagagaccagttatgtggaagtgttcctctctgcctgacccgggaactaactggctactggtgacagctgagcactctggggcacagcaggcagcgccctcactggcctttccacctctcatgagggaggctgaagaagctactcgtggccttcgtccttaagaggggcagggcaggtccacaccaactggcattcggtctggcctagtccacacgacaggccagatagcaccgagtctgaaccgtcctcggttttgaggggagggcacccaggaaaaggcagcatgagccaaagctccgggcaaggccctctgtccccagagccggggcgccgccgcgctactcacgaagcgggaggagttgtcattcttcacggtcttggcgttcccgaaggcctccaggatggggttggcctgcagcagctgccgctccagctcgccctgcaaggaacccagggacgcagtgaaggccgggcagcgacctgggctgccgagcctgccctgcctggaagggggacgatggcagagccgtgtcagcatgtccaacgtgccaggaacagaggtttccgggtgggctccagtgtgcgactccaaccaaggccaggccccggtatcatccaagtgcggccttcccgccaggctttggaaaccttggtcagtttgaacttacttccatggccctggaaacggcaggcaggaagctccctcagctctaggaacctggccctggacgacccatgtgaaagcagcacttaaactagggagccggcggcacagacaccctgggacagtgtctccaccctgtatacaccagcttccctctacctccttgcctctaatcctcacatttttattccttttcataggaaaagcaaatgaggggatcggatctggaaaatatacacgctcatctcatctgtgtcctgataaatgcttcactttctgtaccagcccctccactgccgcgtccaaaaccaccatgacaggcagtgagcacgggatccatgaggcccactttgggctccaggctgtttactgagaatgtcaataaatcctactgtgaactccagggtgctttgtggtagacaaaatgcacccttgtgccttcttatccctggatccccaccatactcacggggcaggacagagcagccccatttcacagaagaggaagctgaggccaagggaggggtgctcaaggtcatccagctatcaatccgcagagcggggtggcggaattccagtcccctccctaacctgtcagccactgccctgtcttcgcacctgtgcaacaggcccatgccaccagggactaactaacgctggctaaggaaactagggagttggttccccttaatgcctgagtgccctctgggggaaagaacgtcacacaagggccaggcaagcctttgtatttattaaagactggaggcaagccagggttttccgggaacagcagccgcctgtgagtgatgacaaggagaactaggaggagtaggagctcccaggagagccatggaccctggccttacaagcacacctgccacagacgagacccatctgcagggcaccggggacactctggagtctagccgagccagattggaagcccacctgagaccacaagggacacagcagagactcttcctctggcagccctcctaggccaggaccccccaacccagggctaggaagccttccgcttgtgaaccatccagacaagtgagggcattgctctagtgcccgcccctgaaggagggtcagcagggccaggtcagagggcaggggtcaagcccacagagcaggctctacgtgtgcgctgggcaccagtggtaactggacaccgggcttccacccacaggcctcgggcgggcctgggaagtcggctgaggcagcccacggagccagacttggatgagaatggctcccccacccactacgccgttcctctcagagcacaggccaggctgccaggctggctgaaccgctcccattcccgcagacagaagggagcgcggcccctccattgcctgtgctcgccctggctgggaggcgaactgaggcctctgtttgggaccacacgctgttgccgtggaaagtggggccgcggggccaagtcgggagcagccacttcagattccagagctgtgttccctgctgacaacagtgatgactaacctatggctttttctctactgacatctaattgggcacagaagagattttaatttttcaatgaaatctgcgtaacatgaaatgatgcggtactgtatgaggtttggggttacccatcggtttctgaagggcttcactgggtggtgtttctgccagtgggccccagctcgtacacaaataacagagcagggagagtcaaaggtcaccgttcaggatccgggcatctgcctggaaagccccttggaccaagctctgctttgccaacctgcggcccaggccaaacctggcctccccgcagcaaggtgaggtctggaacaacccctctgctggtgttgggagggtcaactcggtcactgcaagtgagagagcgctggctcccaaaccaattcaagggtgttctgtgctccggcagcctgtggaaaatcacagcacagcttcaggcaaggaaatcaaccaaaccggccaatggtctttcacgctgacagcctgagctatgactggaagcctggggcaacctactccctcactctagtgggctcagggcagggacggggtgcctaccaaagtctgcgttttgacaacgtggctcccactgtcacccccaaccccagcatgctgtctttgctgagtgctgccttcccctctacaacaggaaccccagatgtaaggcatatgatctatttcactgctctccgtgtcctgtctcctgtctttcaggacaggaactccaatgtcaccctcccaagaaccagtcacatactaggcagtcaataaatacttgggaaatggattttactgcaaattcagagatggaaaagcacagctagagaactcctaacctcacagctctgtttttaaaataggcctcctaaaaagaatggaaaatcgggggtagggagggagagagggatggagagagagagagacagagagggagacagaagaaaagaaactgtattagtttctaaatataactcctgacgccccatggaaaaagattccaaacgtcttgagaagcttggcacatgaaaagttacttttggttcggttccagaagactgtactcattaggccattctgcaggccacaccccagacctgcatgcagactcacacccctccttacttacgaaggccgcacacggcacgccagtaaggtggagccaccgggagcggccaagctcccctgatggcttcaaggaacaccactggcacttagctttcacaggggaggttaagagtgtgtgcttgagagagagcatcccacagccatgcttaagtctgatcaccccaacctctgaaaaactccaacgtgagaactccccggcactgcttctgactggcacggcggtggcaggtgagggcagccggccatctgcatctggtctggaccacagagcgtggagggctccgtgagagcggagtccccatccaccgtgccggggtcaggttccgcatgggacatgacagctatggtgcgctgtggggaaatctgggcatgactggagtttctgagaacaactaggtgtgaggcccgtccccattctgcaggagctgtcatttcagagtgcacaggaggtcactgtgtgccacacccagcccctcctcccaagacagtcagtgagctgagcctaaaagaagagttctagctgcagaaagtgacaagtgtggggtgaaaagctgcttagaacaaaatacagaattcaagggcacacgatgggcagaacacgcattcccagtgcagaacgtgcagtaaacgtgcagctcacctagcgaggacactgctgggttcaaccataatccatcaaaagggagaggaaaaaaatggaggtgagatgactttccaattgccctttctgtcttcgctggggtggtgggggtgggtggctgtccacccagaggcatttcaacagcagggaaaagaaatggaatcaaatacaggtctgcctgagacctttcaagcctccatcaacttgaggaccaagtcttggaatctgccttccagcctcagaaggggaggacacacagcaacgagctgcaaaagccaagagggctgccatgcaaactccaggacctcgccagtttccatagcaactcagaaggctaggaggccaaggatggaatgggcttgctaccgctggaccactcccaggacaggccacgccactgcctcaatggaaatgggcccagcctctgcttcattccccaaagcatcctcttgtaaagctgaagccgggaccactaagtgctcttcctccatcatcccaccaaggccaagcaggcggccacagggacaagggctgcagcactcacctggtccttcttgctcttgtgcgaggacgccacgtacgccagatactggatgaccttcttggtgttctccgtcttgccagctccagattcaccactaccaagagaggcaaggaagtcccgggcttaggcatggccaagtccttgacctctgtcccttcccactgcacgctccactgcctcgcattctgttgggtgcccgtgaaggacccaacgtgtggcagaaaacgggactgccacataaacgctctggaatcctcaggcagttcacttcccatggctctccaggggccagacagaagtaaactgaaatccactgcctgtcctggtcacttgtcagggcaagtgacttcacatccaagtgttttaaaaatcagttttaggcagctgtggacttaggggtcaaaggcacttgtacatgttcctttgaaacgtcacttaaaggaatgttctgtgccattaactctcttggcaatggggtttatggatctccttgttaagttcagaggctgagaggccccagtgtctacttcaattcaggtaaagaaaagccaccatccagagcaagaaggaatgccttccacccagaagttacggaggagctggttcccagctggattgtggagagatcttgcttttcctttctgccataagctccaccctccttcccactggctccttgaggaaggatgattgaaattgagctcatccatgcagtgggaccactgagtagcaaacacacaaactgaagtcctatcccttggagaagtggaggaggggccttgaattgggaatgggggactctgcaagccccagttgtggtttcagtaggagacctcaagaatgagaacagactggggtgaaacgaaccactacccagacggagaaatacttacgtgcacaagatggattgatcttctcggtctgaaacaaagaagacatcagattaactcccgccagatgcaaaagcctccccaccttgctcccaaagagctgcccgtttcccagacagggagcacagtgtcacagatgctgtctttgtggggatctcgcagtctaccctcacacctggctaggaggagcatcttcgggggagagtgccattgggcagctgctcctgccgcccaggagctcagattgtccacccacgctgttcagcccccaccagaaaaccagaaatagttctgtgtctcccaccttagaggaactagtgtgtggaaaactctccaggagtcgacttccctgggagctgagtgggacctgccctgtgtgtttataacggggtggggggctgaagctgttagaaagaagcctgctgcaggtgctctaaataccatccccactgaaggaaggagcaccatttaagaggctggggaaggaggggtgacgaggcctggctttgcaacgggacagccctgggataagatgctgcctcacagcctgagacccgggacaggtgcgcaggcttctctgagccccagctccctcctccgcagcgtgggataacagtacttgtgtccacaacacatgtgaacacaccagcacggtgtctggcaagtggaaggcgtgcaatgatgtcactttagaggcagcttgtaaagaatgacagcttctgatgggtttctgtgacaacctgttctctagccgggtgtcaggaactttcagcaactatcaacagctctatgaactgctcggcaaggaaggttataaatacccaccctcccccagtacaggaggggcagtaatgcccacactctgaaagctaagtttgccagaaacactaaggcatcctggctgttcagtactgggtattcaagcaacagctgaaaatataaactcatttttttccgttttatcccgccccatctaatagcctcaccgtccttgaagtcaaattggcctgaatccaggatcaggctacttacaaatatttgagctgcagtgaggtatttaattctgagtctcagtttctacatccacaaagtaagatctgctactaactcccttgcaggattagtttgaaaaatagaaataacacataaaatggacctgccgcagtccctgtaaagacagtaagctccacaaacggttgctgtctataccgacttccccaacgcgacgtcgccacgatgggtggcagtggcgttgtcagggcagtgggagcatccgtggctgttggtacagtatcagccctgggtggaaacacggattcagcgacgtgtgaaggacacactgagtggctcgcaccacctggtcagggccctgcgtgactaggcactgggagaatgactcacggctttccacgtgcatggcctcaggagacacatttaaccgttcaacaccagtagccaccgaccagctaggctgcctgcctcttccgaggtgagctttctagcatgcctgacctcagcagcgtgtggggctgggcactgcctccaatctcttcttctgcccactggtcattcaggagggaaaaggaagcccagacagaaagaagaaaaaacaaacctcacacccaacaccaatggcagctgcccctgccctgggccgcagcttcctcccagccccctaagcatcaacggggtgggggcgcagaggggctgggtcactctcattcacaaacacaccccacaccctgctctctgatgtggaaactactcaggaggcaagctctaggggaggcaagccttactcccccttgcctttctcaaaaaacacgagtccttcaagcctgcacagcgaggacagagattagagacctgcatcctcgactagacagacgggaagacagaagggagggaggcggcaggaaccacagcctggggaagacagagcaatttcattgctggcccctaacgacagtgtggcaaccgataagggtttggaacaaacatttttgtcatcccagccccctgccctcccccactgcgtctccctgtggtctgccccagctgtgggcatgtttagtcaccggctctactagcaggcaagaatgtacctgcgagtgctggcaagtcgtgagcagccaacggcccaatgctaccataaaaggaaacattccccaacccttccagaggaaccgttttcccagggctgtccctaggatggctggaattcctctaattgtgtgaggaggagtcagaggctctgctgctgaacaacaggaagcagagcccccaaacacactcgagggcatgcacacagaggcgcacgcacgcacaagggcatggacacacacatagacacgcaagcatctgtgcatacacagtcacatatggaggtaggtgtacagaggtacgtgtgcacagaaatacatgcgcacacacgtgtgcaaagccatatacatagatccacacaaggcacacagctgcacacgcattcacagatgcatatccacaagcacaagtgcaaacacaggcacgcaaggcacatgtattcacaggtgaatgtgaacatacatgtatgtacatagccatgcacacacacggatgtatgcacaggcacacacacttcaaattccgaaaccccagagccaaattcagtgtctcctctccatccacccgagcgtccctagctctcccacttctccagccttccccgtccaattcctgaagccaatttaccactgtcaacacagcctaaccataccttaaagaaatctggatttgttctgccaggaacattcatctggacaaatgctttctgaaaggcaaactgctgggaggcctcctcattgcatctcttaccgcactgcttagtatcctaaatccaccggccggatgcaccacgaatcgtaccatggccccatgcaaccgaaaaggtctttccaatgctcaggaagggttttggtctgttatcttgtgtggcctccaataaccttacaaggtattgtattgtaatgtacaaagcaggtattatcatcattgttttgccatctttccacacagcggttcttctggatttgttcctgatctcagaggcatctcttctgggcagtggggtggttagaattcttagcaaccagtgggctctttggcctactcagtttactctgcagcccacctccccaccctatgcattctagtggagactgccattggcgcccaccccatcaacccttccccgcactgtcatctcacaggatgagcacattcagagtccggcccaatctgcttgttttggctcgagtccttatttggcctgtaaggactgaaggcttatttgaaaacgcccttccttcctctaaacgggaggaggccgccagggacaagcctcttctgggacacgagccccctgccagatgaaagtctagccgtggtaggcgcctgaacccactgccccagcccctctcttggtgagggtggggtagagatggggttatgagtcactctgcagtagttttcagacttttcaaaaagcagcggcagtccttcctcagataaaatcttcccaaattcctgagcaagggacagtgggtggtggagacagggttcctcagagcacagtttgacaaccactagtccatgtgtctggagcagttctgcaaaggaggaagccacagccgagagcgctgtggccctgggttccgctcttccccacgcaatgcctggccccttgacctctctgggaatgaagggactgctctgaggatggaaggaaatggtgttcctgtcgtacacggtgtgaggcagatgcccagacatgccgtcctcacccgcctgctgtctcggagctcccaactgagcaattccctggcaccgccacgagaaagtctttcataaaagttacaaattcaggaaccaggccattttctccctggatttcattttcaaccgaaaatgtcctgaggccaagcccatgcagtgagggcatctgagctgatgtggccatctacctgtggacaggtgtttccagccagctcagcaggctgggcccaggagggaggaaggggaacctgaccgcaggtatttcatcccaggtgcagacttctgctgggggcttaagcctcacttcctctgtgagaggagctgcagctcactcttgtccataaaaggccacgaggctcgcagagcggtgacatcagcccaacaggaagtacagaggaaggggcctgcttcaccagcagccactgctgggactgactcatcacccagctcccaagatcacacctcccgaggttccagcatggagcagctctctcgggctccacctgggagaggtccctgcaggaccccatcttcggctccactgggcttcttgagaaatgggtatgggccaagaaagaaaaacaggaaaaagggcagtttcaggttggacaacatgcccacgttgggtgagactgatgggataatctgagacaaatgggaccaaaactttccaccaccagggagtcttctgctttcagggaaactccagagtggcccctggggggtggcttgctatatgtgttggcactgtgagccctgccctgcgttgccaggatggcttgatcagagttgcacaaatggggctgagaactcaggtctctggaaacctcacgcaccccaggactcccctccatcgaacacccctatgagcacagcactcggcacctcccgcaggcctgcctcagtgctgcaaagaaagggccgcgacactctcatgacgagaagctctgcttctccacagccagctcaattcacaagcttgggttacaagtctttgggaggcaaacagagaggtgaagaaaagcaagtgcaaaatgatgcttcatattagcagaggctgcagatctgtgccgagtggggtggagcttcctggcagcctgcctgcctagcaatctgccagcaaaggaggaagccccttccgtcgctcccaggcacacaatgtggtcatgggcgagtgtgccctccaggccaccacggtaggcccagaccaagggacatgcctgctcagcagcatccacaccagaagccagttcgactcggcccagtgcctctgccccatagcccctgtgatctcccaggtggaacctggtttgaacctgctgagacccaagtccccacttataggaggcagagaatgggtagccctccccctccagacactctggataattaaaaaaaaaaaaaaaaaaaaaaaaaaaaacctcaaggtattgctcttaactttcattatgtcagactaagcgaggccccaaacaagccttctcttggccaaaatgcattaggaaaacacaggtaagttcccagcacacaggcaaatctgccagaaacagcactgctgtttctgtgggtggggccaggagggggaaacttctccttctggggttgttgccaaggcagctccaacaggtttgtcagactggagggaaattcaaaaccacatacgagtgctgaccacccacagcacatgccaccgggacactcccagtccggttccgccttgctcctacctaacatttcccttgcgaaaaggaaagacaaagcaggaggggcccctgttgacttctgcagagggctggatcaacagggaataagagggaaggagctgggacacacacagggagcatggcagacacagccaggcactgctcatgacaaactcagctccctgttggagcacaaacaggcctgcaaagacagcaaccagctttgtgaaactccttttgatgagtcaaacgtgcttgagagcaccagggacatcaatggtaggaggtgaacagttaacagcgcatgaacacgttgcctcggaggagcggtcggtagaaggaaaggcatgtcggtgactgttaggctaggattcactcctggagcacggctcacgcttcctctcctttcagcttagacctgtgccctgttgtatctgtggaccagctcatgtggaagagacaagatcttcaggaagaatcccaaagccaggtgggaatgacatcctgagcccccatcagtactgtctgtttgccaaaagaaaacctggggtctcaagagtttatggagtttatgatcaaggtccacacggggctgacagccttggtcaagactaaacaaatttgacagaagccacgtgcagaatcccaacttttatacctgcagcttttcagttcatttatctttctttagttgtagggaattactttggttctcaactgataacttcattccagaaatcaggtatgtaaaagaaagcaactcctttctctgaacacactgttgttcagccctgacaaactgggacacagttcaactgaagtctctaagccagagctggagagaacaggaaaaacgggctggtaggtgacactcaccaggcagcaagagaactcgtcacgggaggccaaaagcacgaagtggcttagtgattagggatttgatgtgagtttttgttgttggtttatttcaggggatggggagcagaaacaaaaaacactgggcaaagcttccaaacacccccacccaaaatttcaggttctaagaggccacttcctttttatctcccgctcagtgggcccagagcaaagcatggtgggcctgttgggttggatttacaaaaaaaaaaaaaagtaagcctaacgctgaatccttgaaaagggcccgttaactgcagattcctcttctagaaagaagaagttctagaaatgagactgacaggcaggaccatgggtagttcagcagcctcatgctggggccgggctttccttcctggaggagcagcacaaagcagccagctcgcatcagctcgaggacagcgcctcccggctgcagccatggtgttgggtggtggcccagggcctgcttcccacagcacctgtctggtccaccagcatcccagggaacagaaaagtgtctcagggctgcagaagaaccaactctggatcaagcacatctcctaaagctccactgaggccacatcagccccaggcctcagctctgcgtggaccagaccagataagccaggaccgcgtctgctatcgcgttccagtgtgtggcgcggtcgctgcaggggcggctgtgacaactcacttcctgcacctggactctcgggagagtgtttttggggagattcaaatggctgcctggaagatgcatttggccatcaccttcattaagcgagcaggagtgtggacggaaggaatgagcgatttgaagcctccgtggaaggcggggcagttcagtcaagaagtgtttggactcctactgccagctctaacaggtacttatcgcaggcatcacacacacggcgtcttacttcttaccatggccctgcccaggagtgtcatgaagcccaagaggaggacaagaggacaaaggctcaattagagtgagttgacttgctccagccaggttgcagttaggaagctaaagaggcagattcctgctctgtctagtccaaaacccacagtctctcctccacgacacacttcctcttgctcaaaggcaatacgtggcactattcccaagtctaaggctgagacaggcccagcagcccctttttggtgccctatagaagtgctgtgtcatctatcaaaggcccgtacccaccccagaagctctcgaggctcggtggggcgcccctcctctgtgctagtctctggctctcatcttgaagctgatttgcctgtctctgagcacgaaacagtcacctcctccaggcaggccccagcctgctgtctgtacactctctgcagagtgcccggcacacacacagtaggtgctcagctcagccagcacagagagaccagcaggtgcagacacagaacacgccccatcttggagagcccacgctgcctccacaggcacatttaggcacacagggcctgctcccaacctccccagcagacagcggtgcctttgtgtgctgacggctggcagggctggcggcctcccggctgggtgcattcctgcttcagcagagtcatcccatctgtggcttccatggcgctccttcctcagctgcctgtcccggtgagtcgattcaaacagagcttttctgccccttgaagctttttcctgagcctctgccaaacatggcacttttcctcagaaagacattggaaagcagacagttccacaggagacacaactagcggggcagggagaatgtggagagaaggaaagagagggcctctcctcccctagtgccccccaaccactgagctggagataagaattccttcaagaccagccagagaaaatgaggggcaccaatgccccacgggcctgtgccagggtaacaggcaccaggacaggaaatcaggagactgctttctggggctggctctctgcgggcttttcgacaagccagttaacattatctgtgcctgcctctttacgtatgaattcgaagagccatgctcagacgtgaagatacacaaaaattctacccctcattgtttacagaaaaaggtcagacaccgaggggcatgtgcacactcactggcactctgagcggctgctgggtgaccaaccacctctggtgcagcttcccttgggaaccagggatcgggtgggaagggagactggcacagagcaaagggttaaattgctctcagacaagtttaggcctagaatgaaagcagatctgcttcccccaaaatgctgggaactcattaaaatattaataccataaagtcactgaaagtgaaccaaacctggcattctacctaattcacatagaaggggctttttctactcactggggagataactgggctcatgtcaaattcctcaaccagtgagttctcctgtagagacatacacacctttccccataggggagaccccagagggtctggcccgggatccagaagcaccatttcctaggcgaggcagaccttttgcagaccacagctgcttccacctgaactttacagcagaccattgtgcctgccccgggacacagtcccacccatcccccgctgcctggcaagggccagcaacacaacgtttacgctctctcactctcctggccttggccagttcaaagcctttggtgccatcacagagttccgagcaacagtccaatccccaaggcaggaagacccaggaacggccatgacaacgaattaacaacatgggaaagccaggggcaggagggtgaaccgaccatgtcacccaaggccacgctgggcacgtctgggatgccctgtaactacttactgactgacacacaccaccgcctttctgcaagatccgacctcgccacacctgacaaaactcccaggacacctgacattggctcagtcgtgctggcgcaggtgtaggcaccaaatgtcttgttttgtagctagggccacaaatctctgtctataaacatgcctcgtctctccacctggaccgccagggcatccagtaacaggataatgtcaaaacctcctggcattctggcaccttctgtcacctacctccacggcctaatccaaggcactacatgctgtgatgccccacccgtgcccacggcagacagcactaatccatctcagaattcctgcatcgagtctcaaatccttgccagcacagggctccaggcagccactactgatcgatcggagatgacactcaaagtaaaactaatctgcaatgcttagtccagtagttcttaactgggaataatcttgccccccacggaaacttgatggcaatgtctgagaatatttttggttgtcacaactggagagggaaggtgtagctggcaccaagtgaatagaggccacgatgctgctaaaaatcctacagtgctcaggaagatcccccacccccaacagagaatcatccagcctcaaatatcactagtgccaagagtgagaatccctggcttagtctgacaataggtgagtgacatataatttatcctccaaactgggatgcttctgaaagtgaaagagagtgctattaataataactgtggaacaacaggcataaatcaggactgtacaggcaaaccagtacactgaacagataaaggcagatggaggtccccaggaagggtcaaagagctcctctcctacaagtccccagacagagccaccaactgccccgtttggcagaataaatgctagtatgtcataaggcacagccagctcaggaaggaaatctttgtctagttcttgtttaaagaaaaagcacaaaaggaactttccggctgtgccttttaagatgtaagtggcagagaacaaatctgtttccctcaaagccaggggggcagcatgcactaagacttcactccaaaagacaggagcagattttaacagcctgcagaccccgaggctccacgggtgacacatgacccagggcaagaaccaaaggttcctctggatatttttcttttactagtgaaccagcttgtcataacatggacaacttctgttactaacttcctccctgctccaagagcaagaaacctattagtatttgctttgcaggtcagctatatacaaaaagaaggaactttcttttcttttttttttttttaattgagaccaagtctcgctctgttgcccaggctggagtccaatgacacgatctcagctcactgcaacctccgccgcccaggttcaagcaattctcatgcctcagcctcctgagtagttgggactacaggcgtgcgccacaatgcctggctaatttttttgtttttttagtagagacagggtttcgccatgttgaccagactggtctcaaactcctgacctcaggtgatccacctgcctcggcctcccaaagtgctgggattacaggtgtaagccaccacacccagccgaagaagaaggaaaatagcctagagacgtccttcgtcagtcaatgtgggagctcaagagctgcagcaagtccaatgctagcagaaggcaaagtgaaaacctctcagactgagggttagaaaacacatggacccaattcctgcacggactgctttaaaggaggcatcaacaatacaagtttcccgtgctcacaaatgtatttcctatccctggtctccaaaagatgaaatcgcccacctggctgggtgcggtggctcacacctataatcccagcactttgggaggccgaggcgggtggatcatgaggttaggagttcaagaccagcctgaccaacatggtgaaaccccgtctctactaaaaatacaaaaaaattagccaggcgtggtagcatgcacctgtaatcccagctactcaggaggctgaggcaggagaattgcttgaacccaggaggcggagcccgcaatgagccgagatcgtgccactgcactccagcctggatgacagagtgagactccatctcaaaaaaaaaaaaaaagaaaaagaaatcgcccacctacctgccctcataatttgcaaatctgatcaaaccacttgattcagaatcttgacaaatcatgaagagaccctgaattgcacagatgtacgagggtggcccctaagttcctatgaaggccattcggtatggccaagaaaaaggaaagctctggttctctgcatccttttttttgtcccccaattactttcaatgtatggagctttcaggccaccaccaaatttttgttgttgttgaacaaataaaaattgaatgaatctcttggagaaggagtcccacaggttaactgaagacagtctgaagtccagatctgaagactgtctcctgcctcatcagtacacattactcagtcttaatgtcttgcctaaaagcaaaaatgcccagttgctagataaccatcccaatccaggatccaagtgtgagaacaggcccttactcagtagctcagatctcaagatgactccggagtacactttttgcactaggccaattaagagagctgggagcaaactgactcataacctctagagacaaagaatcagacctttctggaatcccacagaatgtttttccaccaggctgttctagttagcattttgaaacagacattctactttagaactgaaggcctgacttcctcaagatattttgatagacgtgaacataagccaaagactcggccaaacttgagcatcctacataatgcatcaagctcaacagtaaaatgcctccttcacagcacagcgtgggtggtggaggacaggctgcaagctgccactgtaaaccactaaaccagggacaaagtggttaacccaacaagatgcattaccaccactgtctagatagactgcaaagtttaaagaaaaaaggatccatatgtaatgggacataacaaaccactatccatacaagataggagaacacggccctgcctgaaaattgggtttgagtcaggattacatatgccaggtacttggctaagctctgagaatataaaggcaacatgggccctgtctgtatctaggagagaaaaagaaacgtgtaaacactgcagtcaaataaagcactaccagggctctgatgcaaatctagcccagatattctccttggaggccctaatgcttcagtcatgtttttaaaaaaagaatagggatttgccaggcattgcaggcagatggagcaggtagggtgttctgaagcagaaagagctattagggaaatgtaaggagttccacatagctaggaaggtgggaaggtaggcaaggggccaattttgaagggcactgtacactaacacagagtcacagtgttattaggctagtgcaaaagtaatcgcggtctttgccattacttttaatggcaaagaccgcgattacttttgcagcaacctaatagctctgggggaatgaggagcctttctatgatttgtcaagatttcaaatcaagtgatttgatcacatttacatcccagaaagatgaccagctggtggaagcacagggtagggggctctattaagagtaaagttggccaggcacggtggctcacgcctgtaatcccagcactttgggaggccgaggtgggtggatcacctgaggtcaggagttcgagtccagcctggccaacatggcaaaaccccgtctctactaaaaatacaaaaattagccgtgcatggtggcacaagcctgtaatcccagctactaggggggctgaggcaagagaatcgcttgagcctgggaagcggaggttgcagtgagccaagatcatgccactgcacactccagcctgggtgacagaacgagattccgtctcaaaaaaaaaaaaaaagaaagaaaggaagtggtagagactgtccgatgctggggagaggtgaggtaggaactcctgagagccgtggacttagcaacacacaggtcatacataggtgacctctgttggccagtctggagaaggggtggggacagacagccagggcgaggggagtgaccaggaggtggggatagaggcagtgagcacagacacttcctccacaaagcttcactgcgatggaacagaaggggcacagaagccagagtgacaggggggcagaagccacccgaggctctgcatctgtttgtgtagagatgggaagaactcgaacgtgtttctagactgtggggaagaagcaagaaaggaagagggaaaaacacaaagggaagggaagaacaggaagaagaaggggcctaaaagaaagcagaggggacaggcacaagagctcttgaaaagtatgagaaattgagagaaagattaggaaatgtatattttaaagcttctagaacattctatcaacatataaacatgtcctctggatagccactggccctggctttcatacagaggtctacagacctccatgatgcactgcccatcaccagccactagatcaatgtggcaccaaatgtgacttagcacctgcaaaggtgtcaatgaggccccaggtgaagattcagccccaggtgggcacacactacgtcacccaccttgcatcatactcctgtaggcggtgtctgtgatggcatagatgtgagggggcatctcgtgcctcttcttgcccttgtacatttccacaatctcttcagagtagatgggcaggttcttgtaaggattgatgaccacacagaacaggcctgaataggtctaaagaaaagagcggcagataggaacaggttaggaagtttgattctcagtagtgtacaaactttgtagcaaaatatctgcggcttcaaaggacccctgagtcagcctgatgtgaaggcactccctgatggcccttgctcccagtggcccagctcccgcagccctgctgcaggtgtgaagcaccggcatcctccttctgccctgtaagtgaagatcctccctctccactgcaggagtgctccagcctcataggtcagtgagtgtgcgtatccaccaggcaaggtccgcggccaagcagacaacagcaaagtccagttacaaaactcagatccgaggacaatgagagatgtctttgtcatcgtgagagaggcacaaacagaaaagggctcagctgcagcgcagcaaactgtagaaacacaaatcattccacactgaaggacgctgagagatagtgaagcttacacctttctagcactggaaaaacgcactgtgtcctaaaccaattagatcctttgtgggatagtgggtccctgacagacacctctttctctggaatcttctagagacattcacatgcaaatccctcaaacactttaagactatttcacgtcccccgtgagccttctccaagacttcctctctggaggggaacccaattaatcaacatccttaatgtgaggtacctaaaatatacccaatactccaagtgtgacttgatcaaattcaaataagacccccagagtcagatatcctgagttcaaatctcagcaagggtaaggttcttaacctctctccccctccatttctcgatgtgaaaaacggggacaggcagagctctagacctcattgggtggttatgaggattaaatgaagcacatagcacagcacgcagcatagccttggagaggagctctgggtaggcgaggagaaccatttccaacagcaacagtttacacacatctgtccttcctcatcttcaggtaaatacaccttaccttgtgactacctccgtgtcttcagggaaatatactttaccttgtgactactaattctttttctaataagtttcctgttactttttctcccaagatccctttcccccaccaaaaaaaaaaaaaagattcctaaaagctgcgcaagactcccaagaccacccagggtggcagatgttcagttggggaacgcaaccctcttcaagcaactggagtgacccaagtaccctcttcctaagaaaatgggcctgaggggcctggcgaagtgaagccggggctccacgcaccacatcacctacggccctgcctctgtgaagtgatgatggaaggtcacaaggcattgggcagagctgggagcagactcgggtctccaatgccaacctccttggtcacggaggccagttctccgagctccttccaaccttttgttttctccatcacaagtggcctgcaccttcattgttcatgaagcagccaccatctgagggactgcatgcactacagagtcaacccagccccctccacctgtgccctctccagtcactccaaaactggggatggatcttgtggctgaacccaaagacagggtccacataggaaccagtcatgaagagaaggctcttctcaggcactggccaaaggctatggcacagggaatttccaagcagcaattgactaaaggcagaacccagagggccccaacaaccacacaatggtatgcattcaaaacagctgaggccacacacaggggctcacactggaattccagcacttggggaggccagggtgagaggatcgcttgaggccaggagttcgagaccagcctgggcaaaaaagcaagtttccatcactacaaaaaattaaaaaattaaaataaaaattagctgcgtgtggtggcatgcacctgtagtcccagctactcaagagactgagataggaggatcacttgaggccaggagttcgaggttgcagtaagccatgatggcaacactgtgctccagcctgggtgacagagggagaccctgctcttaaaaaaaaaaaaaaaaaaagagcagctgagcttagaaatggacaagcgtgtttggctgcttggaaaaggagatgcagggcccttgatttcctttcttcctgggataattagtcacttgttttccctccaactgctcttttcacaagagaccaggaaagctctgaagaagtgtaaacacggtattggcaacctgcgggcccaggcatttcaggaggaagagacacgggagcctgttctggtttttcctctgcgtgaatgttgagtggggacaagagagaaggccagggagcagcaaggtcaccccaggagctcagaaacaatcaagctttgttcctggactttgagaaaacccacactctaggaaatccagcccaggaaaaccaaggacacgtggtcgcacactaagggagtgccatggagccagatgtttggaaacagctggtgctgacagcagaaggggaccacgggtcattaggacaagtctttctgacagctgggtgggcacatggtcctatggagtggtctacgggagctcaaagttctctgggctaatcccgtcaaagcagtgatgatggagctaagccctgcggaaagagcactgaggctcaggtgggaggaaggagattcactggatgctcgtggaggcaagacatcgagcaagcggcttcgcgcccacgcggcgcggccacgacacggcgctgctccattcacaggccacagaggctctttgtgcccatccgcccccatcccagggcctcaccccctgaagaaaaagacagagcagctgtggctcagaattagccacgccacccacaatgctgggcaaacaggctgcacgaaggctcctgaggtcatgatttggaagcttgatggagagatagaccatgaatgaggcagcacctccccatccaggcagcacctccccatccaggcggccccgcccaggggcgctgacatgctaataactctgcatctgctggggtctccactagaatgactacagaggccatcaatgggcctcttagtgatgatgcttagaagaaggctggtgagaggcaggaggaactgcacaccagaggtgacagcaaggaagcaaaaatgagagttaatgcctccagccaaagagttctagagaaaaggtgtgggcactacccaccacgcccacccacagtaaaacctctgcgtgtggcttgcaatggaaagacgcagccactaacactgaatgtatctgaataatgactgttccctttcgtgggagggagaggccctgtgcaagctcaggcaggctcaggtgctccacttgttttaattcatatccagcagatcccaaaagagactcaagttaaaaaggcaccaataaagagccaaggagagaaacaggagttattttcacttgtaacacacatcagcagcctgagtccaggcccccaggccttgccccgagccaggtgctggctgggtactttagaaagttcccatggatgccgggtgtggtggctcacgcctgtaatcccagcactttgggaggccgaggcgggaggatcacaaggtcaggagatcgaggccatcctggctaacacggtgaaaccccgtctccactaaaaatacaaaaaattagccgggtgtggtagtgggtgcctgtagtcccagctactcgggaggctgaggcaggagaatggcgtgaacccgggaggcagaggttgcagtgagccgagatcatgccactgcactccagcctgggcgacagggcaagactccgtctcaaaaaaaaaaaaaaaaaaaagttcccatggaatcctcgcagatgaggaagtgagactccacatagccatgtctcatggccagtaaggggcagagctgggatttgaaccaggtcctcgaggctccaactatagcacttaagggctctgctttactgagcagaggccatctcagcttagtggcacagcagagtgggtgtgacataagctataaagcctgccaagaggagcgcctcccaatcccagacagtgaggctgcagctcccatgtcacccccacagacacactgtgcttccttaaagcacagtctgccattcatttatttgcaagtcactaattctgaatttcagtggttaatactccttagggacaggggcctttaatttggtccacatgataatcttatcaagcaacagatgagacacaataggtctgaaaatcaggaacccaagttccagcctcagcctggccaacacctggctgtgtgaccctgcttaagttccttgctatctctgggcctcaattcttcccacctgccatgttagaaggctgggctggggccgggcgtggtggctcacgcctgtaatcccagcactttgggaggacgaggtgggcggatcatgaggtcaggagttccagaccagcctggccaatatggggaaaccccgtctttactaaaaatacaaaaattagccgggcatgctggtgggcacctgtagttgcagctactcaggaggctgaggcaggagaatcgcttgaacccgggaggcagaggttgcaatgagccaagatggcaccacaccactgcacgccagcctgggtgacaaagtgagactccgtctcaaaaaaaaaaaaaaaaagaaggctgggttgtaaaggagactgttccacatatctacttgttgataggtctttgatgagccaggttcatcccccaaagggtgggcatcgatggcagaaaacaaagacctcgttgtcacagactgatttagcaatcaacaaggaaatgcagtcctagtcaggagttccgggcaaatacaatggcccatggctcccattgaaggctttagcacattgcagggcactcagaagcatgagtctacctcgtagaaatgtgcttaagtctgtctgaagtcacacagaaaattaaacggctgaccctttcagagctgctgtctctgtaacagaatgagcctgccaccacctgcttttattacatatgtgaccatgagcaaaatccctcagtctgaaagttggtcttcccatctgtaaagtgggaaggccataataatcttttttcttttttttgtttgagacagggtctcactctgtcgtccaggctggagtgcagtggtgcaatctcggctgactgcacccttgaccccctgggctcaagtgatcctcccacctcagcctctaagaaatagctgggactataggcacgccacactatgcccatctaatttttttatttttttgtagagatggggtttcaccatgttgcccagattggtatcaaactcctgagctcaagccatcctctcgtcttggcctcccaaggtcctgggattgcaggcatgcaccaccatgcccagcctatagtaacctcttcatggcttttttccactaggtcaaaaacattttgaggactgttttattcagcccaaagttcaaggtggctagggcaacataaagaaataaagagctattttaggaataataacaagcagatatttctttcccactggggacaaaaccagaaggaaatatctttgagttgaacagaggaatttggggttgatattggacaggactttgtgaccccagagcccgttgcctctgggatgcataaatgctcatctccctgtctcctaacttggtgatggactgcgtttctgcattttctttcttgccagaagaaagaaaatgacgcccctgatctgctgcatgtgctggccctttgcacatgctgctctctggactctcaatacacttccccttggtcaagcctggcaagggaccagcactaaagtgctggacagagtcccagagcaagtcttactcttggtggctcacctctgctcaaagcacactccctagggaagtaacccacaccaacaagcatccgtaaagaacaagatgggctgggcacagtggctcacgcctgtaatcccagcactttgggaggcccaagcagaagaatcacttgtgctcaggagttcgagaccagccctaggcaacataatgagaccctgtctctaataaaaatattaaaaattagccaggcgtggtggcacaggcctgtagtcccagccaccagagaggctaaggtgggaggatcgcttgagcctaagagtttgaggctgcagtgagctgtgatcatgccactgcactccagtctgggcaacagagctactttgggaggctgaggtgggtggatcacgaggtcaggagttcgagaccagactggccaattaaaaaagaccctgtctcaaaaaaaaaaaaaaaaaacaatagtaagatggcagagataccaaaaatgggcttggggcaaatggtgaagggagaggagatccagtgatgcaagaggaacaaagcaggaaaccaggaactggcactccctactttagaaggaatctactacatttttaaagtgcaaaaagcttattggaaagaaatcaaaagagataaagatatttttaaaaatatcttttaaaatatttcattattttaataatataataaataataaataaataaaatatttaaaatattttattttaagatattttttaaaatattttaaataattaagatattttatttaaaaaaatttttaaagatatttaaaaaataaaatgttaaaaaagaagattttttaaagatattattaaaaataattaaaattcaaaaaaacaggccaggtgcggtggctcgcgcctgtaatgccagcactttgggaggccgaggcgggtggatcacctgaggtcaggcattcaagaccagcctcgccaacatggtgaaaccccgtctctactaaaaatacaaaaatcagccaggcattatggcaggtgcctataatcccagctactcaggaggctcaggaaggaaaatcgcttgaacccaggagacagaggttacagtgagccaagatcacaccattgcactccagcgggggcaacagagcaagactccgtctcaaaaaaaaaaaaaaattaaattaaattaaattaaattaaaaaagaaggaatctacaacattgacctgaaccttcatatttccaccaaaacttgagaacgaaggccagtgggtggccatccctcagacagggccatattcttctccctacgtatgttctaaaacaggcttcctgttttgcttttggctgcaaagggaaaagaataatgctataagaacatcccactaggatgttcagatgtcaaagttcaaggatgtcaccccagcactccttcaagcccccttctcaaccagagagccagggcccaggcacgtgagggtgatgggaagacccgccccccccccccacctcggagccctcagacccagcctgcggggtgccacggcagccacttacgtagatgagccctgagtagtaacgctccttgaggttgtgcagcaccgaggcttcgttgaggcacgtgagctctgccatgtcctccaccttggagaacttgggcgggttcatcttctggatgtcatccttgttcaccttcaccttcttcccattctccaccagctccacgatggcctcttcgcccacctcctccttgaggctggctggctcaaagccactcttgtcggaaggcacccataccagcttcttggcagcccagtcggcctgggccagcggattgttgatgaagtttttatccacatagagatacttatcggcagcttgctgtgccatggtgacttatagccaggacctaagcggggaggagaaggacaacacattacatacaactacgtcagccacacaagatcactcatgctcacacctcttctctttgcaaactgtataggattaagacacagtaaaactctatataaccaggctgcacaactttcttgctccacacttttgggataaagatgtgcatcactgaaaaaacaagttgggcccaggacagtggctcatgcctgtaatcccagcactttgggaggccaaggtaggcatatcacctgaggtcaggagttcaagaccagcctggccaacctggtgaaaacccatctctactaaaaatacaaaaattaaccaggcgtggtggtgcacacctgtcatcctagctactcgggaggctgaggcaggagaatcgcttgaacccaggaggcggaggttgcagtaagccagctcacaccactgcactccagcctgggcaacagaaaaacaagctgatagcagggattttgttagcaactaatggtaaggtgtatcgccctagggtcaatccacaatcaagaaaactattgtgccaaatgaacataacaagagtctcaaagacagatgcaattcaagtcgctatgctacagatacaaaggtagcaaagtagccacacagtttgggaggatttccaacaaaaacaggtttctaatcagccaaaaaacacaactgactacaaccccacatagtggaagtttccagtttaaaaaacttgttattagttcatgaagtcaactaagacaagagaagaaaataaaacatcagtacatgttgccaccagattttaattccatcttgataatacagcccaaaaaaagcacagagaaaagatgccaggttccaagaaacatggagaatgctaagagtgcttccctttggggacactaaggtcaaaagtgaccctcacaattcatgagccaagagaacttaagttcatgtgtgtttgcttttttcaaaactcatttgcaaaatgaagatataaaataggctggggacactggctcaggcctgtaatcctagcactttgggaggccgaggcaggcagatcacctgaggttgggagtttgagaccagcctgaccaacatggagaaaccccgtctctactaaaaatacaaaattagcagggcgtggtggcgcatgcctgtaatcctagctgctcaggaggctgaggcaggagaatcacttgaacccaggaggcgggggttgtggtgagccgagattgtgccatggcactccagcctgggcaacaagagcaaaactccgtctcaaaaaaaagacataaaataacaatgccttatatatctgtatggttttatagtttatgaaatgctttcacacatatttcgctatctcgaaaggtctttgtagtaacaactctgtaaaccaggtaaggtatatattattaccaccaatttacagatgaggaaacaagctccctggatgtaaggggcttctccatagtcatccagtcctgtggcctttccacgactaacaccatcgttattcctgctcagaggcgcaggctgggatcacctgaggtgactaccctagtgtaaaactgactcagcttgtggccaccagaggaggcagcccagaagctcactgcccagctcccgctgggaaatcaaggaagatcaggaaggttttttttccctctatgagatcaagccccctcccctcaggcccctgcaatccaggaagtccccagatccaaacacggaacaccatgggcttttgtgcttccagattccaagagggacttggatcccaaggaggctgggggcatgggagggaaagaacaaagggaaaaatctaggctgaccagaacttttcatctgggctcattagtggttttcagtcaaggccaaggggctcccctggactcactccagaaggggcggttttccaggaaaaaacctttttgctggctccctttcgccaggagggacacaagtcccaggaacagagcttggcagcatcaccagcttccccggccggtggctctgttgacatttcccaacacaggcaaaccccacagacccttgtgggggccagggggcacatccactctgcaaggaccaccctgagagcaggccgggctcagaatgagtcagagcaaacaagacaggaacggtggctgtgaactgcctggccgcccctcgtctttgctgcgggtctgaggtctagggtctataccaggagcagcctccagggcaccaccagcttattttcagctgtctgcacttcaccctggccagtccattcaagcaaatccaaggtttctccctgccaggtaaatcctagttgttctttctccctaccatgtgtctaaccactaactagtcaacaggcacccctagggtcccagcacccaggctccccaaagtctccccatcgcgcccctgccctgctcaagaccttgcagcaatcacagaacacaggtctcaggctgcgggttctcagccttttcatagacctcaaacccacaaaggataactccatgaatagcagagagactcacttgaaccccatgcccccaaaccctaagtgtgttgctgaccccgccaatgaacgcatctgaggacatcggtgcccctcacgagactcctaccgagagcagaaggggcaggggatggttactaagtacctcccagcaccacgctcagtttattcaccacctcacctaactggcaaccatcctgggaaagagctgtctcatcatccccaattcataaactaggaaacagactcagaaagggcaagtcacttgcccagagttgcccaacccaggcatggagtgggacgctaacccagggacgcctggctcctgtgcctggcctcctcccagaacaattgtgcctggggtccctcggaagccaggccggcactggagctgggccctaactgtccccacgagctgagtgtgatgtggggagtggagaggaatgcattccagagcgttcaacaaatatttgccggatgttatcaggtaggcaggaaggctgagtgagccttcccagtgtggaccacatggcccgtcaaaaagcaggcacgttagaactcaagatttactccctcggcccgctactgtcggcgcaagcttgcagcccatcagcagtggcagaatgagctctgaccgtcctcaaacgctgcttcgccccagcaatgccaaccctaacagcaaagaacccatctggtagcctggcttctcggcagcccatgggcaccctcaggctgcagggcccaggcactcagactgccctggaaatccgctctggagggtcacaaacatcacaccagctggcggggaggaattccacccaaccaactgccctcagaacctcaccctgtccgactttcaggctttggtgggagggcaggggacagtcacaggccagtggtgtccacttgaagactagcagaggcctggccaccaagccacagttcttgcaagaggaagagagaatgcatcccaccagggacaccccccgcctccaaggaccaaggctccagctgaaggtcagagccccagcttgctgggcacctccctcccagaacttttcattaagcaaggctgggctctgctcagcctggccaaggacagggctatttggtttcagcaactctgctagaatgacgtgggtgagcagcggcgccaagatcaatacacgggttagaccggcagggagagccgcaaaggtcaggataaacagtggagtttctatgaaagccccctcggccacctgggcaggatcagccacattcaatgatggggagccacagggctgcagcagagctgctgtttccactcgtatcctgtgcctctgggggcgtgtgtgtgtgtgtgtgtgtgtgtgtgtgtataagtgtgttcagtcaggttaatactcagacctctccaggatgcatgtgggttaaaccaccttatctataatccatatgcctcatttatgaatgggggatagtaaagagctgctaaaaattcaataaggggcacgacagcgggatacccgggaggtagtctatcaaacacagcagccagcgtgcagccactccttcctactctgtcctggggctgttaaacagcctctttgaaacttttttttttgagacagagactcactctgttgcccaggctggagtgcaatggcaagatctcagctcgctgcaacctccacctcccagattcaagcaattctcctgtctcaggcttccgagtagctgggactacaggcgcccaccaccacagccggctaatttttgtatttttagtagagatggggttttaggtcaggctggtcttgaactcttgacctcaggtgatctgcccgccttggactcccagagtgctgggattacaggcatgagccactgtgcccaggtgaaactttttaaaactgcccataataaaaaagtttttgaaaataaaagaaaaataatcccctaaattcctgaactccccccaccgcctctccccgccttgcaaaatcagttttctctttcttttcgtggtcctttctggacctggctcatggaaacacttgatttttaactatcaggcagaggacagagtttcagattttgtattttccttacttactgtgactattttcctgtagggctaggatttgcttggtttttgttttttgagatgaagtcttgctctgtcacccaggctagagtgcaatggcacgatctcggctcactgcaacctccatctcctgggttcaagcgattctcccacctcagcctcccgagtagctggcactacaggcgtgtgccaccacgcctggctaattttttgtatttttagtagagacggggtttcaccatgttggcctggctggtctcaaactcctgacctcatgtgatctgcctgccttggcctcccaaagtgctgggattacaggtgtgagccaccacacccagcctcagatttgcttgttaatcaattttatccaacccattttacagatgatgcagtggtggccctgagagaaagtaactctactcggtcacacaagctggggaatgaggacctgaacccagaactcctgacaccaaggcctcactgtccaacatttaatggctgcagcatattctcaatattctcaagtgtttttttcttttttaaggaccacttataaggtttttttaccctcttatctagtataccatctttatttttttttgagatggagtcccgctctatcacccaggctggagtgcagtggcgtgatctcagctcactgcaacctccgcttcccaggttcaagcgattctccgctgcagcctcccgagtagctgggattacaggcatccgccaccacgcccagctaatttttgtagttttagtagaaatggggtttcaccatgttggccaggctggtctcaaactcctgacctcaggtgatctgcctgcctcggcctcccaaagtgctgggcttacaggcgtgagccaccgcacccggccgtagtgtaccaccaccttgagatacattcccaggagtggagttacgggagaaaagaacatacaaacacttctacagtcctgggatgtcccatccaattgttttccaaaagggctgaatcgacatgcactgccatttgagcaggatgtacatgtgaaagcaaccaaccagcatcatcatctaccacttaaaaaaacaaaaaaacaaaaaacaaaacacacacacacacacacacacacacacacacacacacacacacagaggaaagatctccgtggctcagaaagtcccgagctcctgtgggaatgggcaggccagcaagaggttcagaaggaagcaagcagctctcgcccctggagatgagattggatcaggctgaggccatcccccagcgctttccttcccgccggcttcctgcgggtgccagtccaactccaagaaacccaagcagttgcctttttaggccataatcgagcgggacacaaccagaggctaaattaggactctcaggaaatgatgaaactgaaagtaaataggttgaccaaaaacatcttctttcaacccaaaatgtaatgcctcaattatttgccttctccccttccccacaaacatcatatggatcttttatttctccctgttttcccagagaatactctccctccctccctccgtttctctttttacttatttgtgggtttgtctggaaaatgaacagctagcaccttaaagacagaatgtattctactctcagatctttggttgaaacgttgagagcatttccactcccagacaacgagggctgatgtaaacctttctgtgggccaagttctaggctgggagtgtccaagtcatcaccttcaccgtaaagctgcatagaccaaggacctgctaggaagcgctgcatgttctcactcaatccttgcaataatttcatgaggcacatacatactcattttacaggtgggggaaatggggctcagacaaggcacaaaacctagggtcagactcagccccgtgtggcttcaatgccctgctccgtttcccccttagctgccttactggtgaggtcaagggggctacaagaagcaaacaaacagagaaccccccctttattaattaagcagacattgataatgccacctcaaagctgtaaaccccatctccccatgctggcttgcacaagggactccatccttccgacctaaattgctgggtgctaaaagtaagaaagaaggtgggagtgtgaccttgggtgagccatttgagttctctgtgcccagtctgccaggagttgacctaaccaatctccaatggccttgggcacgccaaggcttcagttcagacaccccagcggcctcagcccagacactggaagccctattccagcctcaccactgatgtatgcaagcagcccctctgtttgtttttttccatccccacccccatcctggagaacacaggtgaacatgtcctttctctttctacttgcggccgttggttttgagttaaataaaactatcgaagtagctggcttccattgttaagaaagattctttgggccaggcgtggtggctcatgcctgtaatccctgcactttgggaggctgaggcgagtggatcacctgaggtcaggagtttgagaccagcctggccaaaaccgtgaaaccctgtctctactaaaaatacaaaacttagccaggcgtggtggcgcgtgcctgtaatcctagctactagggaggctgaggcacgagaatcgcttgaacccaggaggcagaggttgcagtgagctgagatggtgccactgcactccagcctgggcaacagagtgagactccatctcaaaaaaaaaaaaaaaaaaaaaaaaaaagattctttgaaagcagctgctataataatgtagaatttttcaagctcatttgattcacttattcaatcaactaatacatagagaatccacatgcaaaaaaatcatgacaaaggcataaagatcccagggggtttctaatgaggtcgcgcggcaggacggacatgaacctaggtgactaggtggagtgtccacctgggcaatgtggtagagtagacagaaagcaagctcctgggcttccttctgtcctgttcactgctgaatccaacacccaaacgcagtaagcacccgctagacagatctgccatgtggatgaatgcagaaactccttgctgtgtggccttcggccggtgccacctctctggcctcaactgtaaatgcagataatattttatgctgccttccctgccttgcagggctgcttaatgcagcatgtattccttaaatacacataatgatgagacaggacacctaccatagtggaacattcatgcagagaggaagaaccacgtcaacaaccggctccaccactgactcagcgaagaagaggagaggaacatgcaacttgccgtgggaacaaagagaaagggacacttccttggacactcaagcgaagagtgtcatggaggatatgacatttaaactgggtcctggaagatgggtagaatattggcagggaagggaagagatggtggaaaggtatcccgggccgagggagaaaagcaagagccaacgtacaggaagaaggtacgatcgctcaataaccacatacaaaacgatgccacggcactatggctatctggggccagagaatcctttgtggtggggctgtcctgtgccacgtggggtatttagcagcagagcagcacccctggcctctacccactagatgccagtcgcaccctgtccccagttgtgacaaccaaatacctctccagacatcaccaaaggtggaaattgggggttgcgggggaagacaaatcacacccggttgagcccactgattgaaggggttcgtgtgaacaaacgcagcactatgaagccagacctctcagtcgtcatcctcccccatctctgaagtgcacgggccaaatctccttaacaaaacagaaatcctcagggcaaaaggattcccaggaccccataaaaatggccattatggatggcattgtcaccaaggaatgacagctccttgtaacatactgtattctaagagatctgacctagattctcctgctggactgtgctttaaagatcctgaatacccaatttaaaagtaaaccaatcaaccaggcagaagagactgatgtgcctccccaggcaggcaagaagcaccttcagaacctccaacacggcagctcagcctgcgactcataagcaaagtcaccagcatcaaagggtccagatgattaacggaagacaagcgggagccacattttggaggctgggggtgggagctgttgacacagctgtgccagctcaccccaccctgggaatcccatcaggctggaatgcagtggcgtgatcttggctcactgcaacctccacctccccggttcaagcaattctcctgcctcagcctcccgagtagctgggactacaggtgcacaccgccacacccggctaattttttgtattttagtagagatggggtttcgccatattggccaggctggtctcgaactcctgagctcaggcaatccgcccgccttggcctcccaaagtgctgggattataggtgtcagccaccgcaccaggcccaaacgctatttattgaatagttttggcaaatcaatctggattagacccaggaaatccatggcttccaccactgggacagccggattatttcccgcccagagctctcccccacaccccttcatatattaataaatatatttaaacacctaccaacgagccatctccacctggtggatgcaccatcacacctgaactcccccaccatctctccccagacccataccctcttctgggtgtccatctctgggagacaccatccatctggccacccaagacagtcaccgtaaactcctccccagccctccgccaacaccactgcccgtgccctgttccagtccaggcccacaggccctcccttctggactgctccaactgcctccctcctggcctcccctgccacttctacagaactcctttctgatgactcacaaattcaaattcctatttatatgacttcctatttcattgatattatttgatcagttcaaaatggttcgacagctccacaccttcaccagaataaaatctgcatgctaagcaagccctctaggaccccacccattcatcttgcccctgcccttccttttgccacagtcattcccagcggtatataatcaattccccagtcacactacactctgctcaggcctccaggccttcaaagaaggcagagaagtgtcctttgtattaggaaccctctctgagatcaaagctcaaacgctcccttctctaaagactttttgcagcaaaaagatgtctcatatctatggccctcccgtctgtgctctgtacttgttccactgtaaccaaacagctaaatactcattatttgtagttttatttgaggacaggaattgggtctcattcatcaattccaaatgtctggcacaatgcctggcccagagcaggtgctcagttaaagtgtcctgaatgaataaatgagaaacaaggccaaaatgaggaagaaagacttaatggggaaggtccccagaggctggaaaatccccttgggctgtggctgtgcaaagagggacagggctggagagctgaaggtaacaggagagccaagttgaaaccacacacgcgtaagggttatagccacctaatttgttacaaacaccaaaccatttatggactaatttttatatcctcaaaacaaaaagggaaagaatgcatactggggctttcaatctacaaagagaaataggactgaggataatttactggttttacatatagttcaaccatctctgttttctagaaccttctagcaccccctgattaaccagtgtagaggcacctaccacctactaccagtccgacataccagaaagaatcttggctggcatggcctctgctcttgctaggatgccatgagaaggtcgtgtgccctcctggaatgctacgcctccatctatcaagtaggtgctggcaacatcaacctttggtatcaactcagaagtgacagacagaagtggaaaaaccacagccatgtgaggtcctggttctgcaaaccctaagataaatgcttgtaatgtaccacaatggagtttatggctttggggccagacagacctggattggagtcccaggtcccctgctcacaattcctgtgaccttgaagctgttagcaccccaatttcctagctttagaatgaggacaaacaccaccaccaccaccaccaccaccaccaccaccaccaccaccacctaacatcagaagagttgtagctcaagctcccagtggagaatggcatgataggaatttccctcccaactcctctatcttgtgattctgagctatttaatccccattcttcctaggaatgacacctgggccctctgaaaatcagttaccaggagtctagtgactctttctgcaggttatatccatccatagaggacagttctcagggacagtgactataaagacagcaatttgcagagggaagagggtttcgtggccgagtaaggatggaatgccgtctccctatggccctcttgcaatcacaatatgcacaaaatgttgtaggaagcagcctgcaaaaagaaatctgcttaacttaggccgggcacagtggctcacacctgtaatcccagcactttgagaggccgaggcgggcggatcacgaggtcaggagatcgagaccatcctggctaacacggtgaaaccccgtctctactaaaaatacaaaaaattagccgggcatggtggcgggcacctgtagtcccagctactctggaggctgaggcaggagaatggcgtgaacctgggagggggagcttgcagtgagccgagatcgcaccactgcactctagcctgggcaacagtgtgagactccatctcaaaaaaaaaaaaaagaaagaaaaagaaaaaagaaatctgcttaactccatcccaggaatatcctgcaggaaaaacctctctccatgctggtctgggaaatgctggtctggtgagatgggcacaaagcctgtggcagaagagctggatttgagtccagcgaggtgctgaccagctgtgcaatcctgcaggcaccacccaggcctcggctttcccacctgcaaaatgtcctatctgctcacaggtatgcacaaggccactctctgcaatacacaccagggctgtcagagcagttatctacagggtgggtcaataaagtggctcctctgtcacccagggctaataacctacagcagcctcgacctaggccctcactctccccaggctaacaaggagtggggggctcctcccagctgccagtgcccaggaggtaggagctgaagactgcgggtgggccccccttccctttccacctcaggaatgttgtttgcttacagaagaagctggaacttgtttccattagcagtattccaacccaagcctgtgttgatgcttagcagataagaaaaccagagaggaacttagtgcccgggccccagagcctgccccatctgcaggttctgcctttgcctccttgaagcgggcatggaggggggctcaggtgactgctgaaagtccaggaaacaatgaaagatgatggcatttgcctgtccaagggagggcctgtggtcactttcactttgcctggcaccgaaggaaactcaggctatcaaaaacaacaccagtacgtatttcaaatcatgttgtacacaatggatataaacaatttttgtcaacttaaaaattaaatgaacaatttcttttaaaaaaaaaatgacaccagaaaccagaatgtggtacatagagtccctcctcctgcatgggaaggggtgggggcaatagcttgggacaggctggaggagataaactggggcagctaacccaggatcttatcagccatttaggaatgtggactttattctagggataattggggaggagcagaggtgacatcagatttgtattttaaagtaattggctgggggtgtacggtggctcacgcctgtaatcccaacactttgggaggacaaggcaggtagatcacgaggtcaggagttcaagaccagcctggccaacatggtgaaaccccatctctactaaaaatacaaaaattagccaggcgtgatggtgtgcgcctgtaatcccagctacccgggaggctgaggccaagaattgcttgaacccaggaggcagaggttgcagtgagccgaaattgcgccactgtactccagcctgggggacagagcgagactctgcctcaaaaataaaaaaaacagaaatcatcctcccttacctgcatggagggggcaatgagaagtcagtggttggaaaatactggggacttgcaaggagggagcttccaatctaagagaagaaaagacagttccctgaccaggctaggtggagagtgattaaatgacacgagagggacaagtgcagccatagactttaccctctgatctcctactccatagagcctggctcgaggagagtcctggaatcaccgtcctacgacagtgagaagtgaccaagcaatcccaggagctccagggccagtgtttccagagcatcttaggcacagatctcatgtggcatgtgtcacacagactacacaataaagtgtccaatggggtgtcctccactaagataccaacttcaggaccacagagacatggctttagatcctcagcacagaaaccatttctgagtcgctctgttgcccgggctggagtgcagtggcacaatcttggctcactgcaacctctgcctcctggattcaagtgattatcccgcctcagctgggactacaggtgcatgccagcacgctcggctaatttttgtattttagtagagatggggtttcaccatgttggccaggatcgtcttgaactcctgacctcaagtgatccacctgcctcagccttccaaagcgctgggattacaggcatgagccactacacccggcctgaaaccatttcttaatgaataaatcaaacaaccaatgagccagggcagaaagcagcaaaagtttgaggccagccctgccatcaccccagaatgatagcccgcccagcatggatagaagtgtgccccctacagcctttataaccccaccccaatgccttccaccagtgcctctcaaccatctttccagccacacctctcttatcccctgctacaaccctccattccagtcactagagcacactccccagagcagcctttgcttcagctgtcacccagagacaagctggagggcccatctccccaattctccacagactgagagtccccaaaaccaagtggacatgccatcgcccccaggcagcctctcctagtatgaattactcatagtatgaattaccctagtatgaattactcacccttctccctcctccccaacaggcccagcgcaatctgccttatacagaaccatggcttcattgcctgtgtcctctgctgtctcttagaactctctagaggcaggaactgtctccccaaccctcttgctcttgcccagggtgctgcagagagagcatcaatgcttgttgaaaataactgaattgttgaaaatgcttgcaagtattttctgggaacctggcagtccaagagaatgaccactccaagggtagctggagggagagacagagggaggcaggaaggagggaaggaaggaaggagaggaggaaacaataggttaagcagcttttgccccatgttaagaggccaggcagacagacctagggctggatctgcagataagtcatctacactggacccttggctttgcttttaattggttcaatatttgcacagtgacatcacacctgcgccttacctactcaataacaagctttctctcagtcacccagaagaaactgcaaagaaaagcaaattgtttcaggtatggtggggacgtcccctcctaaatagtgaggggcagatgatcccctttgactcacccccaggttggaagcggctgacaggggaagggtttggttgggttcaccaagcgcaccaagcatgtccccctgcagatggtatctccccagctggctggaggcttcccacacccccaggagggggaacttgaacccttcagattcctgcagcaaagttattccttcccttagcttctgctgatagaatggtttttctttcctcaagcatgtgagcacagtttgctgaaacccaatgcagaaaaataaccatactcagaagatgtaattatacggccaccgtctcagtgggaaagtgcagcatgagggctttctgagtccacatcacgactgctgagaagtgcaaccagagaccagaaacagaagatcacttttgaaggttgctcagcctagaacccttcaagccttcagcagcttgttatcctctgagtgattatttaaatcacacaaaaaaagcgaatgaatgagaagccactttcccccagtagccatctcacctctagtcctgcagggctgagggctccaaggcagagatcgggtcaccactgcatccccagtgccccacatatgggaggtgctgaactaaagtcatgggagaggctcccatcttcccaaaggtccagactccagggaccaactccagtcaaatctgcgtcacccactcttaagtgcctgatgttaagcccaatcatcttctatcttattgtccaaataagtccacatgactatggtgtggctcatgtctccccttagcaggacagacagcaagggccacccacaatgggccatagcttctctgtggccatccagggtcctcaccctccgccccaccccctgcctcactgataactatatctgccgtacactaatttttattttgtttccaagaggcacatcactggccaggggtcagcaacaatctccctgcattgatcaagcggtcattacagtggactctgatcatgggcttcaaaaggagagggacctgctcatggtgatttttcacttacagccttcacagaaggcatctgaggacgagccgcagccaggaggtagacaggctgcctgtggaatgccagagccaccacttaactaacagcaaactttgcagcttgacttgggccccaagcctcagtttctccacctgtaaaatggagctgatcccagctacccccatggacagctacaaggagccccagtgggtctagctgacagcccccacccccacccccaccagcccctacttctgcattggatcggagtatcgtctaactcacagtgccactgtgatgacaaaataagctcccagagctgggctcggggcagccccgaacaccagcccctcccccatgatctttgcctcctctcaagacagcctgtgtcaccactgagctcataatgagtcagtcacagacgctgccctcacacagcccacttcgagggtttgaagtcacatcctgcctaacccaactcgacatgatttattccaccccaggaaggtagctcatttcccagaattttgttaagccctttagtaaaggagtctgatctggcaaggggctccctttacagccctggctgaacatgcagctcagctcgggcctggaggcaggaaccaccctaagtcagggctgccagaggcgccagggcatctcatccttggggccccaacatttatcttaagctgtaatttttatttttttattttatttttttttgagacagagtctcaccgtcgcccaggctggagtgcagtggcacaatcttggctcgctgcaacctcctgggttcaagcaattctcctgcctcagcctcccaagtagctggcattacaggcatgcaccaccgtacccagctaaattttgtatttttagcagagacggagtttcaccatgttgaccaggctagtctcaaacccctgacctcaagtgatttgcccacctcagccttccaaagtgctgggattacaggcatgagccaccgcacccggcctttttttaaattttaatttaaaaactttttgtcataaatacaaacatgtctaacaaaactgtcacaatgtgacatacacatgctattcactctgattcttttccattcaagtctattttatttcatttctaaacacactggttgcccgccaggcatggtggctcacgcctataatccaggcgctttgggaggctgaggcggacagatcacctgaggtcaggagttcaagacagcctggccaacatggcaaaaccccgtttctactaaaaatacaaaaattagccaggcacggtggtgggcacctgcaatcccagctattcgggaggctgaggcaaaagaatcacttgaacctgggaggcagaatttgcagtgagccaagatcctgccactgcactccagcctgggtgacagagcgagactccatctcaaaaataaataaataaataaacaaacaaactggttgccactcacttcacgacccaccgatgaatctcacttgaaagttcttgaaaaacaccaccgtgacttatctacgctaggaaggagaggaacgatctgcctaagatcacatagccaggccaagcagaaactcaagtccaaagccaaagggaaactcagtgagaggtggggggtcggggggagtgtcccactccaggcaagtgagactcagctgtagcaacccaatcacctgacacattcatctcgtggtgtttacatcatctgatcccgccagccttggcaaagtgaagggtcacgcggcccctccccctaaaaaaggagagagcctcagaggctcagggaggctaagtgacttgcctaggtacagggtttcccgggaacatccctgccgatgtgcaggggcaagagcacaagaacgaaagaggagcccaccttcctcagcatccaaggtaacaagagatcaagtctggcatcagaaacatcacccctcccatctccaggcccagccccacactgaagagatacccagaagtgacggtgttctaaaggcttaaatacaagaaggatcatcagggaggggaaggccactgtgctggagctacagtgatgagccccaggaaagtgatcacccctggggtggcacaacttagactagaacaaacccccatcctgatcctaacggcccccaggctgcatccgttatgcgacactcacgtgtgcacactctacaaatggaaaacccaaagcttctatttgtctaggtcagtggtcaaggacccctttgagaacttgtgagaggtggtgaacgccttgcataccacgttagggggctcgcagagactctgcagtgcggtccatggacttttaggagtcccctggtcacaagctcaaaggtaatggggcactagtgcggcctccttttctaccaaggcaacatgaacaaagacttgaggcaggatctcttccttcgtcaccctccggagggttaagcaggatctcgctgaggaagcaaagctgtggacagaataacccaatagcaagagtccacgtggcacgggagggaggccgattctcctgcactgctctggggtgccctggactccaggaacaagaagcccaaaactgaagggtgaacggtctctcctcccgacatttccatcccttgctccggttctcaaatgagcaagcacacagccagccctggacatatagaaggcatggcaggcaatgccaagctttccagagaagcatcccagagcctcctgcattccccgggggaaatgatcaaatacaagtgaggatgaaatccacttattttgcactttacagaaaaattaacttaccgctcctagactgggttgcggcagcacccttgtctgaaaggctggccaaccccagtgtccttgagcaggcagcctggccggcaggatgaccttaccaagtccttccccagaaacgtgactaccgcttactttaccactcaccaagcagcactcctttgcccaggccacagtctggtttgaaagtggccaaagctgtggctgcacatgaaagaaggaagcagcagcggcccctgctctagagagctgccagatttgggccaatgccatcctgccctggacagagccccaggccccctcctcccctccccagtccaagatgggtgcatacagacttgcacacacacagatatgcatgcacacagacacgtgcaaagatctgtgcacacagaggtgcagagacatgcacacagagacctgtgcaaacagacatgcacatatacaaacacacacacacacatgcctgcatacagacaccccagaggatgctgggatatggccgaagtcaggccaacctggaggtaagcgctggattctcctcactggttcaggaaatccggcaaattatttaaatgtcctgaacctccctttcttcatctgtacaatgggaatgaaaaggcccacctcccaggaccctgttggtaattaaataacggccacttgcactttattctgagtgcttttcaccaggaatctcactttagcacacagcactcttgtgaggtagattctagtggtatcccgttttgcagatggggaaacaaggccagaaggcttacttgctgaaggacacacaggcactagctgccggtgtctgtaccctgcaggtctcacttggggctccaggtcttccatccctaaccactctgctccactgcctctaggggtgcaatgagacagcgaatgcacacagagcatctggcaaggcgtcacataggacctggtcaacagcagttgctccgtgatcaggaaggagaagcgcagaggtggacccgcaagctttccagtagcccagggccaaagcaccagtatctgtcctcctgtctgctaccaatcccctccagcagactcacttttaacccaatttctctaagataacagtgctgggaggtggaggagtgttatctccccacccttacccctcccagctgtctatatcgccctaaacagccaggaatttaataagcctggagttgtctctgactcccaaccacaaccaattcggaatgccccaggtcctgcagcacaacaaaggctgccctgcaaagcccggaagagcctgcgaagcctgccccgtccgcgatagagcatcacattcttcagattcttgtgtaaaagccagaagtaaggcaagggggtgggggtgggggggctctaatttcaacctaagggtcattaaagcctgtgacctgtattaaaagggaagagacccacccctctgcagcccctctgtaccacgctggtcctccaaggtgtatgatactgcacaggtcagcacacccaggcctcacaaccagaaagcgccctcagcctagcgtccccactttgaggacatcaagcctccaggacacacagctagtcaatggcaggagggattttgccagactgatcttcagcatcgtactggtggccactatctatttctttctgtctaacataggtttaaagttctagccagagagtccacagaactaaccccaggtagagttcaggggaagacgttgaggtgctgatggagactcgtgaattccacagtgctcggcagcaagtaattaatctcatgatgaggcgtttttcatgagcatttggcattatatacccacctccccctcgccctggcaaaggcaggaaacagtgggcggcaggccggctctgggcagaaggcgggctgagaacagcatgctggtgggctaggaaggtacgagggggcggtatccattcttcagagggaggacagcaaaaacccaggttccccacaaggaccaggctaaccagacctcacaccagcctgccagccttcacctgctgtctacccgacaggtctcttaggatggaacagggagggctgtaatttacagctggtgccataaagccaactaggtaacgcgacccagcaaccaccactgtgaggctatgtgtggaagtctacaaaaacccaatttcacaactattgtccacatagtggttgaagtgggatgagaaggcaggagaggcgatggaagtagatatggaaaataactggcctgaaaatgaggagctgggagaggattttagatcattcacttgctacctggggctagtcacgtaggttttcttggactctcaacattcccagctacaaaataggaacactaatactgccaccttcatgggattgagagacttttgttgcaataacttgaaagtgactttaacctttgtaacgtgatataaaaaatagactgaaatttttaaacagataaaaatatatcacctggcactgtgccagataaattgtggacagataaaacatataaacaataaagctatactttattagcatcaaaaccctctgtggcatttattttcctcattccacagataaggaaaactgaggcacaaagaaagattgtatgactcactcaaggtcaaagggcctgcaggtgggagaaccaagattagggcagatggtctgagtccagagtgcctgcctatttacctaagcaccagacacacgcccatcatgctggtgaggctcagaagccaaagaaataaagccatctacccaggacatcagggtctgtgccacccacattctagtatgaatatcctcacctgtttctcaagcatgtatcaagtgctcaccatgggcaaggcaccatgcaagggtcctggcgacaaggcctctaaaaggggaagcaagaccagcacataagccagcacagagaattgctaagacatgaagcagtccgctgggaacagtggcataagcgaagcatttggcaacgcacgctcgaaccgcagccatccaacactcgggccagtacctgggagtttaggttatagtcctgcaccagctttctacaacagttcctccttaccggtgtcaaaagtgcttatgacttaacagaggggaggagccacctccaagaacaattggctcacaggcactgggcagaaggcagggcagcctgggagctgggagcagccagggcagcccccacccagttctcaagtgttttgatcagaagtagaagcccggagcagagagcaaagtgggacaaaaggaaaaagcgctggtgaaccaggggtgggcagtggggggtgggaagaagggcaggaggggcattgatacttatcgggagtccatcatgaactagacactgctgagagcatttcatactttagctacccagagaacactaacagatagttctatgaaccagaatttacagatacagaaactggagctcaaagcaattaaacaaccggtagagcaccgtcctggagggctcctcccccagatctgaaggcatccacagaatgtccctggatc

SEQ ID NO: 62 - protein, 1960 aa, Homosapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 63 - DNA, 1330 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 64 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 65 - DNA, 1115 bp, Homo sapiens
ctctaaagccgccatggagcgcgcgtcgctgcgcgccctgctcttcggccccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaggggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaatagccagtgaaaaaaggtgaaggtgccgagctataaacctccagaatattattagtctgcatggttaaaagtagtcatggataactacattaccctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaactttagag

SEQ ID NO: 66 - protein, 277 aa, Homo sapiens [sequence omitted]

SEQ ID NO: 67 - DNA, 1685 bp, Homo sapiens
gagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcaggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaagctccagtcctaggagaacagtccctgggtcagcagccaggaggcggtccataagaatggggacagtgggctctgccagggctgccgcacctgtccagaacaacatgttctgttcctcctcctcatgcatttccagccttg

SEQ ID NO: 68 - protein, 368 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 69 - DNA, 7680 bp, Homo sapiens
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 70 - protein, 2328 aa, Homo sapiens
KSKRQAQQMVQPQSPVAVSQSKPGCYDNGKHYQINQQWERTYLGNVLVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNLNGEPCVLPFTYNGRTFYSCTTEGRQDGHLWCSTTSNYEQDQKYSFCTDHTVLVQTQGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 71 - DNA, 3375 bp, Homo sapiens
agggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaaccc

SEQ ID NO: 72 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 73 - DNA, 4629 bp, Homo sapiens
gggggtgaaaaagggggtttgcagaggctgccctggggctggtgctgaaagaagagcccacagctgacttcatggtgctacaataacctcagaatctacttttcactctcaggagaacccacagtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaatacaaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagtccgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctgggtcgagctggaaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccattgggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgccatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaa

SEQ ID NO: 74 - protein, 1496 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGPKGPTGSPGTSGPPGSAGPPGSPGPQGSTGPQGNSGLPGDPGFKGEAGPKGEPGPHGIQGPIGPPGEEGKRGPRGDPGTLGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIKGQPGTMGLPGPKGSNGDPGKPGEAGNPGVPGQRGAPGKDGKVGPYGPPGPPGLRGERGEQGPPGPTGFQGHPGPPGPPGEGGKPGDQGVPGGPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGAGGLPGPLGPPGPAGLLGEKGEPGPRGLVGPPGSRGNPGSRGENGPTGAVGFAGPQGSDGQPGVKGEPGEPGQKGDAGSPGPQGLAGSPGPHGPNGVPGLKGGRGTQGPPGATGFPGSAGRVGPPGPAGAPGPAGPLGEPGKEGPPGPRGDPGSHGRVGVRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGHLGRAGKRGLPGPQGPRGDKGDHGDRGDRGQKGHRGFTGLQGLPGPPGPNGEQGSAGIPGPFGPRGPPGPVGPSGKEGNPGPLGPLGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 75 - DNA, 300 bp, Homo sapiens
  misc_feature (73)..(73): n = a, c, g or t
  misc_feature (75)..(75): n = a, c, g or t
  misc_feature (96)..(98): n = a, c, g or t
  misc_feature (106)..(106): n = a, c, g or t
  misc_feature (111)..(111): n = a, c, g or t
  misc_feature (113)..(113): n = a, c, g or t
  misc_feature (123)..(124): n = a, c, g or t
  misc_feature (141)..(141): n = a, c, g or t
  misc_feature (155)..(155): n = a, c, g or t
  misc_feature (159)..(159): n = a, c, g or t
  misc_feature (170)..(170): n = a, c, g or t
  misc_feature (172)..(172): n = a, c, g or t
  misc_feature (186)..(186): n = a, c, g or t
  misc_feature (200)..(200): n = a, c, g or t
  misc_feature (207)..(208): n = a, c, g or t
  misc_feature (213)..(213): n = a, c, g or t
  misc_feature (224)..(225): n = a, c, g or t
  misc_feature (228)..(228): n = a, c, g or t
  misc_feature (232)..(232): n = a, c, g or t
  misc_feature (239)..(239): n = a, c, g or t
  misc_feature (251)..(251): n = a, c, g or t
  misc_feature (253)..(253): n = a, c, g or t
  misc_feature (257)..(257): n = a, c, g or t
  misc_feature (262)..(262): n = a, c, g or t
  misc_feature (264)..(266): n = a, c, g or t
  misc_feature (275)..(275): n = a, c, g or t
  misc_feature (283)..(283): n = a, c, g or t
  misc_feature (287)..(287): n = a, c, g or t
  misc_feature (290)..(290): n = a, c, g or t
ggaaaagtgaggcaagatgactgcagatactggggttgggatcaaaagcttatcctatcgctgatactagctngnctcagaagttacttgatctcnnncagcaggngcaangntataagcagnngaagaaaggtgcgaatnacgccacgacaacnctanatcgaggactngnagaggtcattatantggctgctgacgcngagccgnnagaanttatctaacanncgncacngttctgngaagacaaaacncngccntacgngnnngtgcgcagnaaggcagntctnggnagggggtgtg

SEQ ID NO: 76 - protein, 79 aa, Homo sapiens
GFGLGNGAEMWFEILPGLSVMGVCLLIPGLATAYIHRFTNGGKEKRVAHFGYHWSLMERDRRISGVDRYYVSKGLENID

SEQ ID NO: 77 - DNA, 392 bp, Homo sapiens
gatgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcaaacttcgaggggttcgtcctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcattgtgaaagtgttgaaggcacaagcacagagtcagaaagctaaataaaaaaatgaaacttttttt

SEQ ID NO: 78 - protein, 116 aa, Homo sapiens
MVQRLTYRRRLSYNTASNKTRLSRTPGNRIVYLYTKKVGKAPKSACGVCPGKLRGVRPVRPKVLMRLSKTKKHVSRAYGGSMCAKCVRDRIKRAFLIEEQKIIVKVLKAQAQSQKA

SEQ ID NO: 79 - DNA, 20 bp, Homo sapiens
ttccattccacaatgtgctt

SEQ ID NO: 80 - DNA, 20 bp, Homo sapiens
ggccagtggaactacacctt

SEQ ID NO: 81 - DNA, 20 bp, Homo sapiens
aaccgaagcctaacctgaga

SEQ ID NO: 82 - DNA, 20 bp, Homo sapiens
gtcattttgggagcaggttt

SEQ ID NO: 83 - DNA, 20 bp, Homo sapiens
agaagcagtcgtttgtgctg

SEQ ID NO: 84 - DNA, 20 bp, Homo sapiens
tgtacttcatgccggacact

SEQ ID NO: 85 - DNA, 20 bp, Homo sapiens
atctgaagtttggggtcgag

SEQ ID NO: 86 - DNA, 20 bp, Homo sapiens
tctctcccaggaccttccta

SEQ ID NO: 87 - DNA, 20 bp, Homo sapiens
gttcctgtcctgggaatgag

SEQ ID NO: 88 - DNA, 20 bp, Homo sapiens
aaggagatcccaggtcacac

SEQ ID NO: 89 - DNA, 20 bp, Homo sapiens
ccagcctttcggtcttctat

SEQ ID NO: 90 - DNA, 20 bp, Homo sapiens
ctggaggaagttgggaagag

SEQ ID NO: 91 - DNA, 20 bp, Homo sapiens
agcagcttgaaactggcttt

SEQ ID NO: 92 - DNA, 21 bp, Homo sapiens
aacgatggagtccaagttctg

SEQ ID NO: 93 - DNA, 20 bp, Homo sapiens
aggacctggagattgtgctc

SEQ ID NO: 94 - DNA, 20 bp, Homo sapiens
gagtctgggtagacgcatca

SEQ ID NO: 95 - DNA, 20 bp, Homo sapiens
aatacatccagcctgtgtgc

SEQ ID NO: 96 - DNA, 20 bp, Homo sapiens
tggccatagtactgcgtgtt

SEQ ID NO: 97 - DNA, 20 bp, Homo sapiens
ttagcgcaagacacaggact

SEQ ID NO: 98 - DNA, 20 bp, Homo sapiens
cactcgtcgatttgactggt

SEQ ID NO: 99 - DNA, 20 bp, Homo sapiens
tcaaaatggtggtttggcta

SEQ ID NO: 100 - DNA, 20 bp, Homo sapiens
cctacgaggactccttgctc

SEQ ID NO: 101 - DNA, 20 bp, Homo sapiens
gccatgacaatggtgtgaac

SEQ ID NO: 102 - DNA, 20 bp, Homo sapiens
gcaaatggcaccgagatatt

The invention claimed is:

1. A method for determining prognosis or outcome of a cancer in a patient, comprising (1) performing a method selected from the group consisting of nucleic acid hybridization, nucleic acid amplification and an immunological method in order to determine the expression levels of a set of two or more genes, wherein the set comprises at least one upregulated gene (A) that is expressed in greater amounts in tumor samples from a predictor population having the cancer and having a good prognosis or outcome than in tumor samples from the predictor population having the cancer and having a poor prognosis or outcome and at least one downregulated gene (B) that is expressed in lesser amounts in the tumor samples from the predictor population having the cancer and having a good prognosis or outcome than in the tumor samples from the predictor population having the cancer and having a poor prognosis or outcome, wherein the upregulated and downregulated genes are selected as having statistically significant differences in mean expression levels, (2) calculating at least one patient ratio (R) of the expression level of the at least one upregulated gene (A) to the expression level of the at least one downregulated gene (B), wherein the at least one patient ratio (R) is indicative of the prognosis or outcome of the cancer patient, and (3) comparing the patient ratio (R) and a threshold (T) wherein (i) (T) divides the predictor population such that a ratio (R) of the expression of (A) to (B) in the predictor population that is higher than the threshold corresponds to a good prognosis or outcome of a cancer and a ratio (R) of the expression of (A) to (B) in the predictor population that is below the threshold corresponds to a bad prognosis or outcome of a cancer,
(ii) a patient ratio (R) greater than the threshold (T) indicates a better prognosis or outcome of the cancer in the patient than does a patient ratio (R) smaller than the threshold (T),
(iii) if the ratio (R) is set to a threshold of one, a ratio greater than one indicates a greater statistical likelihood of a good prognosis or outcome of the cancer and a ratio less than one indicates a greater statistical likelihood of a bad prognosis or outcome of the cancer, and wherein (iv) the patient ratio (R) and threshold (T) are used by a healthcare professional in the selection of a treatment for the patient.

2. The method of claim 1, wherein there is at least a 2-fold difference in mean expression levels between the at least one upregulated gene (A) and the at least one downregulated gene (B).

3. The method of claim 1, wherein two or more expression ratios $(R_1, R_2, \ldots, R_n)$ are calculated.

4. The method of claim 3, further comprising combining the two or more expression ratios $(R_1, R_2, \ldots, R_n)$.

5. The method of claim 4, wherein the step of combining the two or more expression ratios comprises calculating the geometric mean of the two or more expression ratios using the following formula: $(R_1 R_2 \ldots R_n)^{1/n}$, wherein $R_i$, represents a single ratio value.

6. The method of claim 1, wherein the ratio is calculated by division of the expression level of one upregulated gene by the expression level of one downregulated gene using the formula A/B.

7. The method of claim 1, wherein the ratio is calculated by division of the expression levels of two or more upregulated genes $(A_1, A_2, \ldots, A_n)$ by the expression level of one downregulated gene (B) using the formula $((A_1 A_2 \ldots A_n)^{1/n}/B)$.

8. The method of claim 1, wherein the ratio is calculated by division of the expression level of one upregulated gene (A) by the expression levels of two or more downregulated genes $(B_1, B_2, \ldots, B_m)$ using the formula $(A/(B_1 B_2 \ldots B_m)^{1/m})$.

9. The method of claim 1, wherein the ratio is calculated by division of the expression levels of two or more upregulated genes $(A_1, A_2, \ldots, A_n)$ by the expression levels of two or more downregulated genes $(B_1, B_2, \ldots, B_m)$ using the formula $(A_1 A_2 \ldots A_n)^{1/n}/(B_1 B_2 \ldots B_m)^{1/m}$.

10. The method of claim 1, wherein the expression levels are determined by nucleic acid hybridization or nucleic acid amplification.

11. The method of claim 10, wherein the nucleic acid hybridization is performed using a solid-phase nucleic acid molecule array.

12. The method of claim 10, wherein the nucleic acid amplification method is real-time quantitative RT-PCR.

13. The method of claim 1, wherein the expression levels are determined by an immunological method.

14. The method of claim 13, wherein the immunological method is performed using a solid-phase antibody array.

15. The method of claim 13, wherein the immunological method is an ELISA or ELISPOT assay.

16. The method of claim 1, wherein the cancer is selected from the group consisting of malignant pleural mesothelioma, lung adenocarcinoma, squamous carcinoma, medulloblastoma, prostate cancer, breast cancer, diffuse large B-cell lymphoma, follicular lymphoma and ovarian cancer.

17. The method of claim 1, wherein the patient ratio (R) is set to a threshold (T) of one and a ratio above the threshold (T) indicates a greater statistical likelihood of a good prognosis or outcome of the cancer and a ratio less than the threshold (T) indicates a greater statistical likelihood of a bad prognosis or outcome of the cancer.

* * * * *

UNITED STATES PATENT AND TRADEMARK OFFICE
CERTIFICATE OF CORRECTION

PATENT NO.       : 7,622,260 B2             Page 1 of 1
APPLICATION NO.  : 10/236031
DATED            : November 24, 2009
INVENTOR(S)      : Gordon et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1236 days.

Signed and Sealed this

Fourteenth Day of December, 2010

David J. Kappos
*Director of the United States Patent and Trademark Office*